(12) United States Patent
Shiraiwa et al.

(10) Patent No.: US 12,435,137 B2
(45) Date of Patent: *Oct. 7, 2025

(54) ANTIGEN-BINDING MOLECULE CONTAINING TWO ANTIGEN-BINDING DOMAINS THAT ARE LINKED TO EACH OTHER

(71) Applicant: Chugai Seiyaku Kabushiki Kaisha, Tokyo (JP)

(72) Inventors: Hirotake Shiraiwa, Shizuoka (JP); Tatsuya Kawa, Shizuoka (JP)

(73) Assignee: CHUGAI SEIYAKU KABUSHIKI KAISHA, Tokyo (JP)

( * ) Notice: Subject to any disclaimer, the term of this patent is extended or adjusted under 35 U.S.C. 154(b) by 814 days.

This patent is subject to a terminal disclaimer.

(21) Appl. No.: 17/264,388

(22) PCT Filed: Aug. 2, 2019

(86) PCT No.: PCT/JP2019/030564
§ 371 (c)(1),
(2) Date: Jan. 29, 2021

(87) PCT Pub. No.: WO2020/027330
PCT Pub. Date: Feb. 6, 2020

(65) Prior Publication Data
US 2022/0195045 A1 Jun. 23, 2022

(30) Foreign Application Priority Data

Aug. 3, 2018 (JP) ................................ 2018-146929

(51) Int. Cl.
*C07K 16/28* (2006.01)
*C12N 15/63* (2006.01)

(52) U.S. Cl.
CPC ...... *C07K 16/2809* (2013.01); *C07K 16/2818* (2013.01); *C12N 15/63* (2013.01); *C07K 2317/31* (2013.01); *C07K 2317/52* (2013.01); *C07K 2317/55* (2013.01); *C07K 2317/569* (2013.01); *C07K 2317/75* (2013.01); *C07K 2317/76* (2013.01)

(58) Field of Classification Search
CPC ............ C07K 16/2818; C07K 16/2809; C07K 2317/31; C07K 2317/52; C07K 2317/55; C07K 2317/569; C07K 2317/75; C07K 2317/76; C12N 15/63

See application file for complete search history.

(56) References Cited

U.S. PATENT DOCUMENTS

| | | | |
|---|---|---|---|
| 6,344,443 B1 | 2/2002 | Liu et al. | |
| 7,612,181 B2 | 11/2009 | Wu et al. | |
| 8,193,321 B2 | 6/2012 | Bostrom et al. | |
| 9,127,071 B2 | 9/2015 | Yoshida et al. | |
| 9,334,331 B2 | 5/2016 | Igawa et al. | |
| 10,421,807 B2 | 9/2019 | Gonzales et al. | |
| 11,274,151 B2 | 3/2022 | Naoi et al. | |
| 11,718,672 B2 | 8/2023 | Naoi et al. | |
| 2006/0121042 A1 | 6/2006 | Dall'Acqua et al. | |
| 2007/0071675 A1 | 3/2007 | Wu et al. | |
| 2007/0237767 A1 | 10/2007 | Lazar et al. | |
| 2007/0286859 A1 | 12/2007 | Lazar et al. | |
| 2008/0014205 A1 | 1/2008 | Horowitz et al. | |
| 2010/0150918 A1 | 6/2010 | Kufer et al. | |
| 2010/0322946 A1 | 12/2010 | Bostrom et al. | |
| 2012/0328624 A1 | 12/2012 | Yoshida et al. | |
| 2013/0129723 A1* | 5/2013 | Blankenship ...... | C07K 16/2803 435/69.6 |
| 2013/0330345 A1 | 12/2013 | Igawa et al. | |
| 2014/0112914 A1 | 4/2014 | Nezu et al. | |
| 2014/0341906 A1* | 11/2014 | Taylor ................... | C07K 16/00 435/69.6 |
| 2015/0166636 A1 | 6/2015 | Igawa et al. | |
| 2015/0166654 A1 | 6/2015 | Igawa et al. | |
| 2017/0037130 A1 | 2/2017 | Raum et al. | |
| 2017/0274072 A1 | 9/2017 | Kumagai et al. | |
| 2017/0306036 A1 | 10/2017 | Vu et al. | |

(Continued)

FOREIGN PATENT DOCUMENTS

| | | |
|---|---|---|
| EP | 1293514 A1 | 3/2003 |
| EP | 1293514 B1 | 11/2006 |

(Continued)

OTHER PUBLICATIONS

C. Wu et al. (2009). Molecular construction and optimization of anti-human IL-1α/β dual variable domain immunoglobulin (DVD-Ig) molecules. mAbs 1(4): 339-347. DOI: 10.4161/mabs.1.4.8755 (Year: 2009).*

C.G. Jakob et al. (2013). Structure reveals function of the dual variable domain immunoglobulin (DVD-Ig) molecule. mAbs 5(3): 358-363. (Year: 2013).*

M. Kinder et al. (2013). Engineered Protease-resistant Antibodies with Selectable Cell-killing Functions. The Journal of Biological Chemistry 288(43): 30843-30854. (Year: 2013).*

Vaks et al. Antibodies (2018) 7(3): 27. (Year: 2018).*

Igawa et al. U.S. Appl. No. 17/280,239, filed 2021 Antigen-Binding Molecule Comprising Altered Antibody Variable Region (Year: 2021).*

(Continued)

*Primary Examiner* — Julie Wu
*Assistant Examiner* — Elizabeth A Shupe
(74) *Attorney, Agent, or Firm* — Nixon & Vanderhye P.C.

(57) ABSTRACT

In a non-limiting embodiment, the present invention relates to antigen-binding molecules comprising two or more antigen-binding domains which are linked with each other. In a non-limiting embodiment, the antigen-binding molecules of the present disclosure have activity of holding two or more antigen molecules at spatially close positions, activity of regulating interaction between two or more antigen molecules, activity of regulating activation of two or more antigen molecules which are activated by association with each other, resistance to protease cleavage, or such.

12 Claims, 31 Drawing Sheets

Specification includes a Sequence Listing.

(56) References Cited

U.S. PATENT DOCUMENTS

| | | |
|---|---|---|
| 2019/0092854 A1 | 3/2019 | Gonzales et al. |
| 2019/0119406 A1* | 4/2019 | Zhang ............... C07K 16/065 |
| 2021/0301016 A1 | 9/2021 | Naoi et al. |
| 2022/0112296 A1 | 4/2022 | Igawa et al. |
| 2022/0251201 A1 | 8/2022 | Naoi et al. |
| 2023/0121511 A1 | 4/2023 | Chichili et al. |
| 2024/0010725 A1 | 1/2024 | Naoi et al. |
| 2024/0400721 A1 | 12/2024 | Naoi et al. |

FOREIGN PATENT DOCUMENTS

| | | | |
|---|---|---|---|
| EP | 1752471 A1 | 2/2007 | |
| EP | 1752471 B1 | 11/2008 | |
| EP | 2647707 A1 | 10/2013 | |
| EP | 3070168 A1 | 9/2016 | |
| EP | 3130606 A1 | 2/2017 | |
| EP | 3143043 A2 | 3/2017 | |
| EP | 3219724 A1 | 6/2017 | |
| EP | 3227332 A1 | 10/2017 | |
| EP | 3305322 A1 | 4/2018 | |
| EP | 2647707 B1 | 9/2018 | |
| EP | 3227332 B1 | 11/2019 | |
| EP | 3831854 A1 | 6/2021 | |
| JP | 4937138 B2 | 5/2012 | |
| WO | WO9219973 A1 | 11/1992 | |
| WO | WO9418221 A1 | 8/1994 | |
| WO | WO9514714 A1 | 6/1995 | |
| WO | WO0042072 A2 | 7/2000 | |
| WO | WO0177342 A1 | 10/2001 | |
| WO | WO2005070966 A2 | 8/2005 | |
| WO | WO2006019447 A1 | 2/2006 | |
| WO | WO2006047340 A2 | 5/2006 | |
| WO | WO2006047639 A2 | 5/2006 | |
| WO | WO2006072620 A1 | 7/2006 | |
| WO | WO2006083706 A2 | 8/2006 | |
| WO | WO2008119567 A2 | 10/2008 | |
| WO | WO2008157379 A2 | 12/2008 | |
| WO | WO2009025846 A2 | 2/2009 | |
| WO | WO2009080252 A1 | 7/2009 | |
| WO | WO2010027981 A1 | 3/2010 | |
| WO | WO2010035012 A1 | 4/2010 | |
| WO | WO2010080538 A1 | 7/2010 | |
| WO | WO2011133886 A2 | 10/2011 | |
| WO | WO2012064792 A2 | 5/2012 | |
| WO | WO2012096994 A2 | 7/2012 | |
| WO | WO2012143524 A2 | 10/2012 | |
| WO | WO2012162067 A2 | 11/2012 | |
| WO | WO2012162068 A2 | 11/2012 | |
| WO | WO2013026833 A1 | 2/2013 | |
| WO | WO2013026839 A1 | 2/2013 | |
| WO | WO2013055958 A1 | 4/2013 | |
| WO | WO2013059593 A1 | 4/2013 | |
| WO | WO2013093809 A1 | 6/2013 | |
| WO | WO2013126746 A2 | 8/2013 | |
| WO | WO2013180200 A1 | 12/2013 | |
| WO | WO2013187495 A1 | 12/2013 | |
| WO | WO2014116846 A2 | 7/2014 | |
| WO | WO2015068847 A1 | 5/2015 | |
| WO | WO2015138615 A2 | 9/2015 | |
| WO | WO2016040856 A2 | 3/2016 | |
| WO | WO2016122702 A1 | 8/2016 | |
| WO | WO2016194992 A1 | 12/2016 | |
| WO | WO2017021349 A1 | 2/2017 | |
| WO | WO-2017070608 A1 * | 4/2017 | ............ A61P 35/00 |
| WO | WO2017096361 A1 | 6/2017 | |
| WO | WO2017191101 A1 | 11/2017 | |
| WO | WO2018027204 A1 | 2/2018 | |
| WO | WO2018114754 A1 | 6/2018 | |
| WO | WO2018162517 A1 | 9/2018 | |
| WO | WO2018232088 A1 | 12/2018 | |
| WO | WO2019111871 A1 | 6/2019 | |
| WO | WO2019131988 A1 | 7/2019 | |
| WO | WO2020027330 A1 | 2/2020 | |
| WO | WO2020067399 A1 | 4/2020 | |
| WO | WO2020067419 A1 | 4/2020 | |
| WO | WO2021157679 A1 | 8/2021 | |
| WO | WO2021200898 A1 | 10/2021 | |
| WO | WO2021201087 A1 | 10/2021 | |
| WO | WO2023054423 A1 | 4/2023 | |

OTHER PUBLICATIONS

Chichili et al. U.S. Appl. No. 17/914,432, filed 2022 Method for Producing Multispecific Antigen-Binding Molecules. (Year: 2022).*

Kawa. U.S. Appl. No. 17/797,540, filed 2022 Methods for Producing And/Or Enriching Recombinant Antigen-Binding Molecules (Year: 2022).*

Vaks (Antibodies (2018) 7(3): 27 (Year: 2018).*

U.S. Appl. No. 17/280,239—Antigen-Binding Molecule Comprising Altered Antibody Variable Region. filed 2021. Published 2022. (Year: 2021).*

U.S. Appl. No. 17/797,540—Methods for Producing and/or Enriching Recombinant Antigen-Binding Molecules. filed 2022. Published 2023. (Year: 2022).*

U.S. Appl. No. 17/914,432—Method for Producing Multispecific Antigen-Binding Molecules. filed 2022. Published 2023. (Year: 2022).*

U.S. Appl. No. 17/216,981, filed Mar. 30, 2021, Naoi et al.

U.S. Appl. No. 18/343,850, filed Jun. 29, 2023, Naoi et al.

Amann, M., et al., "Therapeutic window of an EpCAM/CD3-specific BiTE antibody in mice is determined by a subpopulation of EpCAM-expressing lymphocytes that is absent in humans," Cancer Immunol Immunother., 58:95-109 (2009).

Ashkenazi, A., "Directing cancer cells to self-destruct with pro-apoptotic receptor agonists" Nat Rev Drug Discov., 7(12):1001-1012 (2008).

Brinkmann, U., et al., "The Making of Bispecific Antibodies," mAbs, 9(2):182-212 (2017).

Carter, P.J. and Lazar, G.A., "Next generation antibody drugs: pursuit of the 'high-hanging fruit'," Nat Rev Drug Discov., 17(3):197-223 (2018).

Chan, A.C. and Carter, P.J., "Therapeutic antibodies for autoimmunity and inflammation," Nat Rev Immunol., 10(5):301-316 (2010).

Clackson, T., et al., "Making Antibody Fragments Using Phage Display Libraries," Nature 352(6336):624-628 (1991).

Clark, M.R., "IgG Effector Mechanisms," Chem Immunol., 65:88-110 (1997).

De Jong, R.N., et al., "A Novel Platform for the Potentiation of Therapeutic Antibodies Based on Antigen-Dependent Formation of IgG Hexamers at the Cell Surface," PLoS Biol., 14(1):e1002344 (2016).

Dillon, T.M., et al., "Structural and Functional Characterization of Disulfide Isoforms of the Human IgG2 Subclass," J Biol Chem., 283(23):16206-16215 (2008).

Dreier, T., et al., "Extremely Potent, Rapid and Costimulation-independent Cytotoxic T-cell Response Against Lymphoma Cells Catalyzed by a Single-chain Bispecific Antibody," Int J Cancer, 100:690-697 (2002).

Dubrot, J., et al., "Treatment with anti-CD137 mAbs causes intense accumulations of liver T cells without selective antitumor immunotherapeutic effects in this organ," Cancer Immunol Immunother., 59:1223-1233 (2010).

Ferran, C., et al., "Cytokine-related Syndrome Following Injection of Anti-cd3 Monoclonal Antibody: Further Evidence for Transient in Vivo T Cell Activation," Eur J Immunol., 20(3):509-515 (1990).

Frey, N.V. and Porter, D.L., "Cytokine release syndrome with novel therapeutics for acute lymphoblastic leukemia," Hematology Am Soc Hematol Educ Program, 2016(1):567-572 (2016).

Garber, K., "Bispecific antibodies rise again," Nat Rev Drug Discov., 13:799-801 (2014).

Golay, J., et al., "Design and Validation of a Novel Generic Platform for the Production of Tetravalent IgG1-like Bispecific Antibodies," J Immunol., 196(7):3199-3211 (2016).

Greenwood, J., et al., "Structural Motifs Involved in Human IgG Antibody Effector Functions," Eur J Immunol., 23(5):1098-1104 (1993).

(56) References Cited

OTHER PUBLICATIONS

Hess, J., et al., "Cancer Therapy with Trifunctional Antibodies: Linking Innate and Adaptive Immunity," Future Oncol., 8(1):73-85 (2012).
Hill, B.Z., et al., "Human antibody-based chemically induced dimerizers for cell therapeutic applications," Nat Chem Biol., 14(2):112-117 (2018).
Houot, R., et al., "Therapeutic effect of CD137 immunomodulation in lymphoma and its enhancement by Treg depletion," Blood, 114:3431-3438 (2009).
Huet, A.H., et al., "Multivalent nanobodies targeting death receptor 5 elicit superior tumor cell killing through efficient caspase induction," mAbs, 6(6):1560-1570 (2014).
Igawa, T., et al., "Antibody recycling by engineered pH-dependent antigen binding improves the duration of antigen neutralization," Nat Biotechnol., 28(11):1203-1207 (2010).
International Preliminary Report on Patentability dated Mar. 23, 2021 in International Appl. No. PCT/JP2019/038087, 8 pages.
International Search Report and Written Opinion dated Dec. 24, 2019 in International Appl. No. PCT/JP2019/038087, 11 pages.
Ishiguro, T., et al., "An anti-glypican 3/CD3 bispecific T cell-redirecting antibody for treatment of solid tumors," Sci Transl Med., 9(410):eaal4291 (2017).
Jefferis, R. and Lund, J., "Interaction Sites on Human IgG-Fc for FcgammaR: Current Models," Immunology Letters, 82(1-2):57-65 (2002).
Jo, M. and Jung, S.T., "Engineering therapeutic antibodies targeting G-protein-coupled receptors," Exp Mol Med., 48(2):e207 (2016).
Jones, H.E., et al., "Growth Factor Receptor Interplay and Resistance in Cancer," Endocrine-related Cancer, 13:S45-S51 (2006).
Kontermann, R.E., "Dual targeting strategies with bispecific antibodies," mAbs, 4(2):182-197 (2012).
Lazar, G.A., et al., "Engineered Antibody Fc Variants With Enhanced Effector Function," PNAS, 103(11):4005-4010 (2006).
Lee, N.-K., et al., "Cell-type specific potent Wnt signaling blockade by bispecific antibody," Sci Rep., 8:766 (2018).
Li, F., and Ravetch, J.V., "Antitumor activities of agonistic anti-TNFR antibodies require differential FcγRIIB coengagement in vivo," PNAS, 110(48):19501-19506 (2013).
Mack, M., et al., "A small bispecific antibody construct expressed as a functional single-chain molecule with high tumor cell cytotoxicity," Proc Natl Acad Sci USA, 92:7021-7025 (1995).
Mariuzza, R.A., "The Structural Basis of Antigen-Antibody Recognition," Ann Rev Biophys Biophys Chem., 16:139-159 (1987).
Mezzanzanica, D., et al., "Human Ovarian Carcinoma Lysis by Cytotoxic T Cells Targeted by Bispecific Monoclonal Antibodies: Analysis of the Antibody Components," Int J Cancer, 41:609-615 (1988).
Mimoto, F., et al., "Fc Engineering to Improve the Function of Therapeutic Antibodies," Curr Pharm Biotechnol., 17(15):1298-1314 (2016).
Morgan, A., et al., "The N-terminal end of the CH2 domain of chimeric human IgG1 anti-HLA-DR is necessary for C1q, FcγRI and FcγRIII binding," Immunol., 86:319-324 (1995).
Moritz, B., et al., "Assessment of Disulfide and Hinge Modifications in Monoclonal Antibodies" Electrophoresis, 38(6):769-785 (2017).
Mukai, T., et al., "Codon Reassignment in the *Escherichia coli* genetic code," Nucleic Acids Res., 38(22):8188-8195 (2010).
Nimmerjahn, F. and Ravetch, J.V., "Fcγ receptors as regulators of immune responses," Nat Rev Immunol., 8:34-47 (2008).
Orita, T., et al., "A novel therapeutic approach for thrombocytopenia by minibody agonist of the thrombopoietin receptor," Blood, 105(2):562-566 (2005).
Pan, Q., et al., "Blocking Neuropilin-1 Function Has an Addictive Effect with Anti-VEGF to Inhibit Tumor Growth," Cancer Cell, 11:53-67 (2007).
Pavlou, A.K. and Belsey, M.J., "The therapeutic antibodies market to 2008," Eur J Pharmaceut Biopharmaceut., 59:389-396 (2005).
Peggs, K.S., et al., "Cancer immunotherapy: co-stimulatory agonists and co-inhibitory antagonists," Clin Exp Immunol., 157(1):9-19 (2009).
Porter, D.L., et al., "Chimeric Antigen Receptor-Modified T Cells in Lymphoid Leukemia," N Engl J Med., 365(8):725-733 (2011).
Rader, C., "DARTs take aim at BiTEs," Blood, 117(17):4403-4404 (2011).
Reichert, J.M., et al., "Monoclonal antibody successes in the clinic," Nat Biotechnol., 23(9):1073-1078 (2005).
Riechelmann, H., et al., "Adoptive therapy of head and neck squamous cell carcinoma with antibody coated immune cells: a pilot clinical trial," Cancer Immunol Immunother., 56(9):1397-1406 (2007).
Roitt, et al., Immunology, M., Mir, (2000), pp. 110-111 (in Russian, with what is believed to be a published English equivalent of those pages taken from Roitt et al., "Antibody Structure and Function," Immunology, Fifth Ed., (1998), pp. 80-81).
Rothe, A. and Rubbert, A., "Recombinant proteins in rheumatology—recent advances," New Biotechnol., 28(5):502-510 (2011).
Schabowsky, R. H., et al., "A novel form of 4-1BBL has better immunomodulatory activity than an agonistic anti-4-1BB Ab without Ab-associated severe toxicity," Vaccine, 28:512-522 (2009).
Scheer, J.M., et al., "Reorienting the Fab Domains of Trastuzumab Results in Potent HER2 Activators," PloS One, 7(12):e51817 (2012).
Schlereth, B., et al., "T-cell activation and B-cell depletion in chimpanzees treated with a bispecific anti-CD19/anti-CD3 single-chain antibody construct," Cancer Immunol Immunother., 55:503-514 (2006).
Sebastian, M., et al., "Treatment of non-small cell lung cancer patients with the trifunctional monoclonal antibody catumaxomab (anti-EpCAM x anti-CD3): a phase I study," Cancer Immunol Immunother., 56:1637-1644 (2007).
Seimetz, D., et al., "Development and approval of the trifunctional antibody catumaxomab (anti-EpCAM x anti-CD3) as a targeted cancer immunotherapy," Cancer Treatment Rev., 36:458-467 (2010).
Shinkawa, T., et al., "The Absence of Fucose but Not the Presence of Galactose or Bisecting N-Acteylglucosamine of Human IgG1 Complex-type Oligosaccharides Shows the Critical Role of Enhancing Antibody-dependent Cellular Cytotoxicity," J Biol Chem., 278(5):3466-3473 (2003).
Singer, et al., Genes & Genomes, Moscow, Mir, 63-64, 68-69 (1998).
Staerz, U.D., et al., "Hybrid antibodies can target sites for attack by T cells," Nature, 314:628-631 (1985).
Staerz, U.D. and Bevan, M.J., "Hybrid hybridoma producing a bispecific monoclonal antibody that can focus effector T-cell activity," Proc Natl Acad Sci., 83:1453-1457 (1986).
Torres, M. and Casadevall, A., "The immunoglobulin constant region contributes to affinity and specificity," Trends Immunol., 29(2):91-97 (2008).
Unkeless, J.C., et al., "Structure and Function of Human and Murine Receptors for IgG," Annual Review of Immunology, 6:251-281 (1988).
Vinay, D.S., and Kwon, B.S., "4-1BB signaling beyond T cells," Cell Mol Immunol., 8:281-284 (2011).
Wolf, E., et al., "BiTEs: bispecific antibody constructs with unique anti-tumor activity," Drug Discov Today, 10(18):1237-1244 (2005).
Wozniak-Knopp, G., et al., "Introducing antigen-binding sites in structural loops of immunoglobulin constant domains: Fc fragments with engineered HER2/neu-binding Sites and antibody properties," Protein Eng Des Sel., 23(4):289-297 (2010).
Zeidler, R., et al., "Simultaneous Activation of T Cells and Accessory Cells by a New Class of Intact Bispecific Antibody Results in Efficient Tumor Cell Killing," J Immunol., 163(3):1246-1252 (1999).
Zhang, H., et al., "Selection of antibodies that regulate phenotype from intracellular combinatorial antibody libraries," Proc Natl Acad Sci USA, 109(39):15728-15733 (2012).
U.S. Appl. No. 13/990,088, filed Dec. 19, 2013, Nezu et al.
U.S. Appl. No. 15/310,358, filed Jun. 12, 2017, Kumagai et al.
U.S. Appl. No. 17/280,239, filed Mar. 26, 2021, Igawa et al., related application.
U.S. Appl. No. 17/670,917, filed Feb. 14, 2022, Naoi et al., related application.

(56) References Cited

OTHER PUBLICATIONS

U.S. Appl. No. 17/797,540, filed Aug. 4, 2022, Kawa, related application.
U.S. Appl. No. 17/914,432, filed Sep. 26, 2022, Chichili et al., related application.
Baeuerle, P.A. and Reinhardt, C., "Bispecific T-cell Engaging Antibodies for Cancer Therapy," Cancer Res., 69(12):4941-4944 (2009).
Beljaars, C., et al., "The Preferential Homing of a Platelet Derived Growth Factor Receptor-recognizing Macromolecule to Fibroblast-like Cells in Fibrotic Tissue," Biochem Pharmacol., 66(7):1307-1317 (2003).
Berntzen, G., et al., "Identification of a High Affinity FcgammaRIIA-binding Peptide That Distinguishes FcgammaRIIA from FcgammaRIIB and Exploits FcgammaRIIA-Mediated Phagocytosis and Degradation," J Biol Chem., 284(2):1126-1135 (2009).
Binetruy-Tournaire, R., et al., "Identification of a Peptide Blocking Vascular Endothelial Growth Factor (VEGF)-Mediated Angiogenesis," EMBO J., 19(7):1525-1533 (2000).
Brennand, D.M., et al., "A Cyclic Peptide Analogue of Loop III of PDGF-BB Causes Apoptosis in Human Fibroblasts," FEBS Lett., 419(2-3):166-170 (1997).
Bulman, M.P., et al., "Mutations in the Human Delta Homologue, Dll3, Cause Axial Skeletal Defects in Spondylocostal Dysostosis," Nat Genet., 24(4):438-441 (2000).
Campoli, M., et al., "Immunotherapy of malignant disease with tumor antigen-specific monoclonal antibodies," Clin Cancer Res., 16(1):11-20 (2010).
Chamarthy, S.P., et al., "Gene Delivery to Dendritic Cells Facilitated by a Tumor Necrosis Factor Alpha-Competing Peptide," Mol Immunol., 41(8):741-749 (2004).
Chen, C., et al., "Enhancement and Destruction of Antibody Function by Somatic Mutation: Unequal Occurrence Is Controlled by V Gene Combinatorial Associations," EMBO J., 14(12):2784-2794 (1995).
Chen, W., et al., "Characterization of Human IgG Repertoires in an Acute HIV-1 Infection," Exp Mol Pathol., 93(3):399-407 (2012).
Conrad, M.L., et al., "TCR and CD3 Antibody Cross-reactivity in 44 Species," Cytometry, 71A:925-933 (2007).
Dall'Acqua, W.F., et al., "Modulation of the Effector Functions of a Human IgG1 Through Engineering of Its Hinge Region," J Immunol., 177(2):1129-1138 (2006).
De Pascalis, R., et al., "Grafting of Abbreviated Complementarity-Determining Regions Containing Specificity-Determining Residues Essential for Ligand Contact to Engineer a Less Immunogenic Humanized Monoclonal Antibody," J Immunol., 169(6):3076-3084 (2002).
Deambrosis, I., et al., "Inhibition of CD40-CD154 Costimulatory Pathway by a Cyclic Peptide Targeting CD154," J Mol Med., 87(2):181-197 (2009).
Dermer, G.B., "Another Anniversary for the War on Cancer," Biotechnol., 12:320 (1994).
Dufner, P., et al., "Harnessing Phage and Ribosome Display for Antibody Optimisation," Trends Biotechnol., 24(11):523-529 (2006).
Eigenbrot, C. and Fuh, G., "Two-in-One antibodies with dual action Fabs," Curr Opin Chem Biol., 17(3):400-405 (2013).
Faham, A. and Altin, J.G., "Antigen-containing Liposomes Engrafted with Flagellin-related Peptides Are Effective Vaccines That Can Induce Potent Antitumor Immunity and Immunotherapeutic Effect," J Immunol., 185(3):1744-1754 (2010).
Hetian, L., et al., "A Novel Peptide Isolated from a Phage Display Library Inhibits Tumor Growth and Metastasis by Blocking the Binding of Vascular Endothelial Growth Factor to Its Kinase Domain Receptor," J Biol Chem., 277(45):43137-43142 (2002).
Hezareh, M., et al., "Effector Function Activities of a Panel of Mutants of a Broadly Neutralizing Antibody Against Human Immunodeficiency Virus Type 1," J Virol., 75(24):12161-12168 (2001).
Holen, H.L., et al., "Activation of EphA Receptors on Cd4+cd45ro+ Memory Cells Stimulates Migration," J Leukoc Biol., 87(6):1059-1068 (2010).

Ikuta, K., et al., "Expression of Human Immunodeficiency Virus Type 1 (HIV-1) Gag Antigens on the Surface of a Cell Line Persistently Infected with HIV-1 That Highly Expresses Hiv-1 Antigens," Virology, 170(2):408-417 (1989).
Kraft, S., et al., "Definition of an Unexpected Ligand Recognition Motif for alphav beta6 Integrin," J Biol Chem., 274(4):1979-1985 (1999).
Kramer, A., et al., "Molecular Basis for the Binding Promiscuity of an Anti-p24 (HIV-1) Monoclonal Antibody," Cell, 91(6):799-809 (1997).
Kussie, P.H., et al., "A Single Engineered Amino Acid Substitution Changes Antibody Fine Specificity," J Immunol., 152(1):146-152 (1994).
Lederman, S., et al., "A Single Amino Acid Substitution in a Common African Allele of the CD4 Molecule Ablates Binding of the Monoclonal Antibody, OKT4," Mol Immunol., 28(11):1171-1181 (1991).
Li, B., et al., "Activation of the Proapoptotic Death Receptor DR5 By Oligomeric Peptide and Antibody Agonists," J Mol Biol., 361(3):522-536 (2006).
Li, C.H., et al., "Beta-Endorphin Omission Analogs: Dissociation of Immunoreactivity From Other Biological Activities," Proceedings of the National Academy of Sciences, 77(6):3211-3214 (1980).
Lightfield, K.L., et al., "Critical Function for Naip5 in Inflammasome Activation by a Conserved Carboxy-terminal Domain of Flagellin," Nat Immunol., 9(10):1171-1178 (2008).
Lum, L.G. and Thakur, A., "Targeting T Cells with Bispecific Antibodies for Cancer Therapy," BioDrugs, 25(6):365-379 (2011).
Lutterbuese, R., et al., "T Cell-Engaging BiTE Antibodies Specific for EGFR Potently Eliminate KRAS- and BRAF-Mutated Colorectal Cancer Cells," Proc Natl Acad Sci., 107(28):12605-12610 (2010).
MacCallum, R.M., et al., "Antibody-antigen Interactions: Contact Analysis and Binding Site Topography," J Mol Biol., 262(5):732-745 (1996).
Mullendore, M.E., et al., "Ligand-dependent Notch Signaling Is Involved in Tumor Initiation and Tumor Maintenance in Pancreatic Cancer," Clin Cancer Res., 15(7):2291-2301 (2009).
Nakamura, T., et al., "Peptide Mimics of Epidermal Growth Factor (EGF) with Antagonistic Activity," J Biotechnol., 116(3):211-219 (2005).
Phillips, H.S., et al., "Molecular Subclasses of High-grade Glioma Predict Prognosis, Delineate a Pattern of Disease Progression, and Resemble Stages in Neurogenesis," Cancer Cell, 9(3):157-173 (2006).
Rao, W.H. and Camp, R.D.R., "Novel Cyclic and Linear Oligopeptides That Bind to Integrin beta1 Chain and Either Inhibit or Costimulate T Lymphocytes," Int Immunopharmacol., 3(3):435-443 (2003).
Richards, J.L., et al., "A Peptide Containing a Novel FPGN CD40-binding Sequence Enhances Adenoviral Infection of Murine and Human Dendritic Cells," Eur J Biochem., 270(10):2287-2294 (2003).
Rudikoff, S., et al., "Single Amino Acid Substitution Altering Antigen-binding Specificity," Proc Natl Acad Sci., 79(6):1979-1983 (1982).
Schraa, A.J., et al., "RGD-Modified Anti-cd3 Antibodies Redirect Cytolytic Capacity of Cytotoxic T Lymphocytes Toward alphavbeta3-expressing Endothelial Cells," Int J Cancer, 112(2):279-285 (2004).
Shanmugam, A., et al., "Synthetic Toll Like Receptor-4 (TLR-4) Agonist Peptides As a Novel Class of Adjuvants," PloS One, 7(2):e30839 (2012).
Stancovski, I., et al., "Mechanistic Aspects of the Opposing Effects of Monoclonal Antibodies to the ERBB2 Receptor on Tumor Growth," Proc Natl Acad Sci., 88(19):8691-8695 (1991).
Traxlmayr, M.W., et al., "Integrin Binding Human Antibody Constant Domains—probing the C-Terminal Structural Loops for Grafting the RGD Motif," J Biotechnol., 155(2):193-202 (2011).
Turnpenny, P.D., et al., "Novel Mutations in DLL3, A Somitogenesis Gene Encoding a Ligand for the Notch Signalling Pathway, Cause a Consistent Pattern of Abnormal Vertebral Segmentation in Spondylocostal Dysostosis," J Med Genet., 40(5):333-339 (2003).
Tutt, A., et al., "Trispecific F(Ab')3 Derivatives That Use Cooperative Signaling via the TCR/CD3 Complex and CD2 to Activate and Redirect Resting Cytotoxic T Cells," J Immunol. 147(1):60-69 (1991).

(56) References Cited

OTHER PUBLICATIONS

Vajdos, F.F., et al., "Comprehensive Functional Maps of the Antigen-binding Site of an Anti-ErbB2 Antibody Obtained With Shotgun Scanning Mutagenesis," J Mol Biol., 320(2):415-428 (2002).
Witte, L., et al., "Monoclonal Antibodies Targeting the VEGF Receptor-2 (Flk1/KDR) As an Anti-Angiogenic Therapeutic Strategy," Cancer Metastasis Rev., 17(2):155-161 (1998).
Wu, B., et al., "Structures of the CXCR4 Chemokine Gpcr with Small-Molecule and Cyclic Peptide Antagonists," Science, 330(6007):1066-1071 (2010).
Wu, H., et al., "Humanization of a Murine Monoclonal Antibody by Simultaneous Optimization of Framework and CDR Residues," J Mol Biol., 294(1):151-162 (1999).
Yu, L., et al., "Interaction Between Bevacizumab and Murine VEGF-A: A Reassessment," Invest Ophthalmol Vis Sci., 49(2):522-527 (2008).
U.S. Appl. No. 09/349,661, filed Jul. 8, 1999, Liu et al.
U.S. Appl. No. 11/259,133, filed Oct. 27, 2005, Dall'Acqua et al.
U.S. Appl. No. 11/748,980, filed May 15, 2007, Horowitz et al.
U.S. Appl. No. 11/766,581, filed Jun. 21, 2007, Lazar et al.
U.S. Appl. No. 11/766,624, filed Jun. 21, 2007, Lazar et al.
U.S. Appl. No. 12/552,177, filed Sep. 1, 2009, Bostrom et al.
U.S. Appl. No. 12/594,713, filed Oct. 9, 2009, Kufer et al.
U.S. Appl. No. 13/575,861, filed Sep. 12, 2012, Yoshida et al.
U.S. Appl. No. 17/216,981, filed Mar. 30, 2021, Naoi et al., related application.
U.S. Appl. No. 18/343,850, filed Jun. 29, 2023, Naoi et al., related application.
U.S. Appl. No. 17/280,239, filed Mar. 26, 2021, Igawa et al.
U.S. Appl. No. 17/670,917, filed Feb. 14, 2022, Naoi et al.
U.S. Appl. No. 17/797,540, filed Aug. 4, 2022, Kawa.
U.S. Appl. No. 17/914,432, filed Sep. 26, 2022, Chichili et al.
Grujic, O., et al., "Impact of antibody subclass and disulfide isoform differences on the biological activity of CD200R and βklotho agonist antibodies," Biochem Biophys Res Commun., 486(4):985-991 (2017).
Gura, T., "Systems for Identifying New Drugs Are Often Faulty," Science, 278(5340):1041-1042 (1997).
Kirley, T. L., et al., "Selective disulfide reduction for labeling and enhancement of Fab antibody fragments," Biochem Biophys Res Commun., 480(4):752-757 (2016).
Wu, X. and Demarest, S. J., "Building blocks for bispecific and trispecific antibodies," Methods, 154:3-9 (2019).
Bostrom, J., et al., "Variants of the Antibody Herceptin That Interact with HER2 and VEGF at the Antigen Binding Site," Science, 323(5921):1610-1614 (2009).
Bostrom, J., et al., Supporting Online Material for "Variants of the Antibody Herceptin That Interact with HER2 and VEGF at the Antigen Binding Site," Science, 323(5921):1610-1614 (2009).
Chen, S., et al., "Bispecific antibodies in cancer immunotherapy," Hum Vaccine Immunother., 12(10):2491-2500 (2016).
Chiu, M. L., et al., "Antibody Structure and Function: The Basis for Engineering Therapeutics," Antibodies, 8(4):55 (2019).
Clark, L. A., et al., "Influence of canonical structure determining residues on antibody affinity and stability," J Struct Biol., 185(2):223-227 (2014).
Escobar-Cabrera, E., et al., "Asymmetric Fc Engineering for Bispecific Antibodies with Reduced Effector Function," Antibodies, 6(2):7 (2017).
Hummer, A. M., et al., "Advances in computational structure-based antibody design," Curr Opin Struct Biol., 74:102379 (2022).
Janeway, Jr., C. A., et al., "Immunobiology: The Immune System in Health and Disease," $5^{th}$ edition, section 3.6 (2001).
Office Action dated Jun. 4, 2024 in U.S. Appl. No. 17/280,239, filed Mar. 26, 2021, Igawa et al.
Schlothauer, T., et al., "Novel human IgG1 and IgG4 Fc-engineered antibodies with completely abolished immune effector functions," Protein Eng Des Sel., 29(10):457-466 (2016).
Shang, Y., et al., "Characterization of the Native and Denatured Herceptin by ELISA and QCM using a High-Affinity Single Chain Fragment Variable (scFv) Recombinant Antibody," Anal Chem., 84(19):8164-8170 (2012).
Shen, J., et al., "Single Variable Domain-IgG Fusion," J Biol Chem., 281(16):10706-10714 (2006).
Somasundaram, C., et al., "Development of a trispecific antibody conjugate that directs two distinct tumor-associated antigens to CD64 on myeloid effector cells," Hum Antibodies, 9(1):47-54 (1999).
U.S. Appl. No. 13/885,421, filed Aug. 30, 2013, Igawa et al.
U.S. Appl. No. 18/654,675, filed May 3, 2024, Naoi et al., related application.
U.S. Appl. No. 18/696,717, filed Mar. 28, 2024, Naoi et al., related application.
U.S. Appl. No. 18/978,252, filed Dec. 12, 2024, Noai et al., related application.
Bönisch, M., et al., "Novel $C_H1:C_L$ interfaces that enhance correct light chain pairing in heterodimeric bispecific antibodies," Protein Eng Des Sel., 30(9):685-696 (2017).

* cited by examiner

ANTIGEN-BINDING MOLECULE CONTAINING TWO ANTIGEN-BINDING DOMAINS THAT ARE LINKED TO EACH OTHER

CROSS-REFERENCE TO RELATED APPLICATIONS

This application is a U.S. National Phase of PCT Application No. PCT/JP2019/030564, filed Aug. 2, 2019, which claims the benefit of Japanese Patent Application No. 2018-146929, filed Aug. 3, 2018, each of which is incorporated herein by reference in its entirety.

REFERENCE TO SEQUENCE LISTING SUBMITTED ELECTRONICALLY

The content of the electronically submitted sequence listing (Name: 6663_0165 Sequence_Listing.txt; Size: 2.11 megabytes; and Date of Creation: Jan. 27, 2021) filed with the application is incorporated herein by reference in its entirety.

TECHNICAL FIELD

The present disclosure relates to antigen-binding molecules containing a first antigen-binding domain and a second antigen-binding domain which are linked with each other, methods for producing such an antigen-binding molecule, methods for using such an antigen-binding molecule, and pharmaceutical compositions containing such an antigen-binding molecule. The present disclosure also relates to methods for increasing resistance of an antigen-binding molecule to protease cleavage.

BACKGROUND ART

Antibodies are proteins which specifically bind to an antigen with high affinity. It is known that various molecules ranging from low-molecular compounds to proteins can be antigens. Since the technique for producing monoclonal antibodies was developed, antibody modification techniques have advanced, making it easy to obtain antibodies that recognize a particular molecule. Now the antibody modification techniques are not only for modifying proteins themselves, but have also expanded into a field that aims at addition of new functions where conjugation with low molecular compounds is contemplated. For example, cysteine-engineered antibodies, which contain a free cysteine amino acid in the heavy chain or light chain, are used as antibody-drug conjugates (ADCs) for medical purposes (PTL 1).

Meanwhile, the antibody modification techniques have contributed to not only the development of antibody engineering as tools for detecting, analyzing and purifying proteins, but also the development of protein engineering in general, such as improving the function of a non-antibody protein using an antibody molecule itself as a model protein.

Antibodies are drawing attention as pharmaceuticals because they are highly stable in blood plasma and have less side effects. Not only do antibodies bind to an antigen and exhibit agonistic or antagonistic effects, but they also induce cytotoxic activity mediated by effector cells (also referred to as effector functions) including ADCC (Antibody Dependent Cell Cytotoxicity), ADCP (Antibody Dependent Cell Phagocytosis), and CDC (Complement Dependent Cytotoxicity). Taking advantage of these antibody functions, pharmaceuticals for cancer, immune diseases, chronic disease, infections, etc. have been developed (NPL 1).

For example, pharmaceuticals utilizing an agonist antibody against a costimulatory molecule promoting activation of cytotoxic T cells have been developed as anti-cancer agents (NPL 2). Recently, immune checkpoint-inhibiting antibodies with antagonist activity on co-inhibitory molecules were found to be useful as anticancer agents. This finding led to the launch of a series of antibody pharmaceuticals inhibiting the interaction of CTLA4/CD80 or PD-1/PD-L1: Ipilimumab, Nivolumab, Pembrolizumab, and Atezolizumab (NPL 1).

However, such antibodies sometimes do not sufficiently exert expected effects in their original native IgG form. Therefore, second generation antibody pharmaceuticals, in which the functions of the native IgG antibody have been artificially enhanced or added, or diminished or deleted, depending on the purpose of use, have been developed. The second generation antibody pharmaceuticals include, for example, antibodies with enhanced or deleted effector functions (NPL 3), antibodies binding to an antigen in an pH-dependent manner (NPL 4), and antibodies binding to two or more different antigens per molecule (antibodies binding to two different antigens are generally referred to as "bispecific antibodies") (NPL 5).

Bispecific antibodies are expected to be more effective pharmaceuticals. For example, antibodies with enhanced antitumor activity which crosslink a cytotoxic T cell with a cancer cell by binding to a protein expressed on the cell membrane of the T cell as one antigen and to a cancer antigen as the other antigen have been developed (NPL 7, NPL 8, and PTL 2). The previously reported bispecific antibodies include molecules with two antibody Fab domains each having a different sequence (common light chain bispecific antibodies and hybrid hybridomas), molecules with an additional antigen-binding site attached to the N or C terminus of antibody (DVD-Ig and scFv-IgG), molecules with one Fab domain binding to two antigens (Two-in-one IgG), molecules in which the loop regions of the CH3 domain have been engineered to form new antigen-binding sites (Fcab) (NPL 9), and molecules with tandem Fab-Fab (NPL 10).

Meanwhile, antibodies with effector functions readily cause side effects by acting even on normal cells that express a target antigen at low levels. Thus, efforts have been made to allow antibody pharmaceuticals to exert their effector functions specifically on target tissue. Previously reported examples are antibodies whose binding activity changes upon binding to a cell metabolite (PTL 3), antibodies which become capable of binding to an antigen upon protease cleavage (PTL 4), and a technology that regulates antibody-mediated crosslinking between chimeric antigen receptor T cells and cancer cells by addition of a compound (ABT-737) (NPL 11).

Agonist antibodies may be difficult to obtain depending on the target. In particular, for membrane proteins such as G-protein-coupled receptors, many different techniques have been developed (NPL 12). Thus, there is a demand for simple methods for enhancing the agonistic effect of antibodies on such targets. Known existing methods include, for example, a method of crosslinking an anti-DR4 (Death Receptor 4) or anti-DR5 (Death Receptor 5) antibody (NPL 13), a method of multimerizing nanobodies of anti-DR5 (Death Receptor 5) antibody (NPL 14), a method of converting an anti-thrombopoietin receptor antibody into a covalent diabody, sc(Fv)2 (NPL 15), a method of changing the IgG subclass of anti-CD40 antibody (NPL 16), a method of hexamerizing an anti-CD20 antibody (NPL 17), and a method of producing a circular, antibody-like molecule (PTL 5). In addition, reported methods using bispecific antibodies include, for example, a method of using a combination of two appropriate anti-erythropoietin antibodies against different epitopes as a bispecific antibody (NPL 18), a method of using a combination of an antibody for guide functions and an antibody for effector functions as a bispecific antibody (NPL 19), and a method of introducing Cys residues into multiple antibody fragments specific for different epitopes and conjugating them (NPL 20, NPL 21, and PTL 6).

CITATION LIST

Patent Literature

[PTL 1] WO 2016/040856
[PTL 2] WO 2008/157379'
[PTL 3] WO 2013/180200
[PTL 4] WO 2009/025846
[PTL 5] WO 2017/191101
[PTL 6] WO 2018/027204

Non-Patent Literature

[NPL 1] Nature Reviews Drug Discovery (2018) 17, 197-223
[NPL 2] Clinical and Experimental Immunology (2009) 157, 9-19
[NPL 3] Current Pharmaceutical Biotechnology (2016) 17, 1298-1314
[NPL 4] Nature Biotechnology (2010) 28, 1203-1208
[NPL 5] MAbs (2012) 4, 182-197
[NPL 6] Nature Reviews Immunology (2010) 10, 301-316
[NPL 7] Sci Transl Med (2017) 9(410), eaα14291
[NPL 8] Blood (2011) 117(17): 4403-4404
[NPL 9] Protein Eng Des Sel (2010) 23(4), 289-297
[NPL 10] J Immunol (2016) 196(7): 3199-3211
[NPL 11] Nature Chemical Biology (2018) 14, 112-117
[NPL 12] Exp Mol Med (2016) 48(2): e207
[NPL 13] Nature Reviews Drug Discovery (2008) 7, 1001-1012
[NPL 14] MAbs (2014) 6(6): 1560-1570
[NPL 15] Blood (2005) 105(2): 562-566
[NPL 16] J Biol Chem (2008) 283(23): 16206-16215
[NPL 17] PLoS Biol (2016) 14(1): e1002344
[NPL 18] Proc Natl Acad Sci USA (2012) 109(39): 15728-15733
[NPL 19] Scientific Reports (2018) 8, Article number: 766
[NPL 20] PLoS One (2012) 7(12): e51817
[NPL 21] Nucleic Acids Res (2010) 38(22): 8188-8195

SUMMARY OF INVENTION

Technical Problem

The above-mentioned efforts to enhance or diminish the agonistic action or effector function of antibody pharmaceuticals are still under development, and more efforts are expected. The present invention has been made under these circumstances. An objective of the present invention is to provide novel antigen-binding molecules that have activity of regulating interaction between two or more antigen molecules, or methods for producing or using such antigen-binding molecules. The present invention may be useful for screening and development of antibody pharmaceuticals, and may also be applicable to other various protein engineering techniques.

Solution to Problem

In one non-limiting aspect, the present inventors modified antigen-binding molecules (e.g., antibodies) which have agonist activity and contain two antigen-binding domains (e.g., Fab portions) by introducing amino acid mutations into the antigen-binding domains, and produced molecules in which the antigen-binding domains were linked with each other. As a result, the inventors found that the agonist activity of the molecules was greatly improved. In addition, in one non-limiting aspect, the present inventors found antigen-binding molecules which acquired resistance to protease digestion through linkage between the antigen-binding domains.

The present disclosure is based on these findings, and specifically encompasses embodiments exemplified below.
 [1] An antigen-binding molecule comprising a first antigen-binding domain and a second antigen-binding domain, wherein the two antigen-binding domains are linked with each other via one or more bonds.
 [2] The antigen-binding molecule of [1], wherein at least one of the bonds linking the two antigen-binding domains is a covalent bond.
 [3] The antigen-binding molecule of [2], wherein the covalent bond is formed by direct crosslinking of an amino acid residue in the first antigen-binding domain with an amino acid residue in the second antigen-binding domain.
 [4] The antigen-binding molecule of [3], wherein the crosslinked amino acid residues are cysteine.
 [5] The antigen-binding molecule of [4], wherein the formed covalent bond is a disulfide bond.
 [6] The antigen-binding molecule of [2], wherein the covalent bond is formed by crosslinking of an amino acid residue in the first antigen-binding domain with an amino acid residue in the second antigen-binding domain via a crosslinking agent.
 [7] The antigen-binding molecule of [6], wherein the crosslinking agent is an amine-reactive crosslinking agent.
 [8] The antigen-binding molecule of [7], wherein the crosslinked amino acid residues are lysine.
 [9] The antigen-binding molecule of [1], wherein at least one of the bonds linking the two antigen-binding domains is a noncovalent bond.
 [10] The antigen-binding molecule of [9], wherein the noncovalent bond is an ionic bond, hydrogen bond, or hydrophobic bond.
 [11] The antigen-binding molecule of [10], wherein the ionic bond is formed between an acidic amino acid and a basic amino acid.
 [12] The antigen-binding molecule of [11], wherein the acidic amino acid is aspartic acid (Asp) or glutamic acid (Glu), and the basic amino acid is histidine (His), lysine (Lys), or arginine (Arg).
 [13] The antigen-binding molecule of any one of [1] to [12], wherein at least one of amino acid residues from which the bonds between the antigen-binding domains originate is an artificially-introduced mutated amino acid residue.
 [14] The antigen-binding molecule of [13], wherein the mutated amino acid residue is a cysteine residue.

[15] The antigen-binding molecule of any one of [1] to [14], wherein at least one of the first and second antigen-binding domains has, by itself, activity of binding to an antigen.

[16] The antigen-binding molecule of any one of [1] to [15], wherein the first and second antigen-binding domains are both antigen-binding domains of the same type.

[17] The antigen-binding molecule of any one of [1] to [16], wherein at least one of the bonds linking the two antigen-binding domains is formed by linking amino acid residues present at the same position on the first antigen-binding domain and the second antigen-binding domain with each other.

[18] The antigen-binding molecule of any one of [1] to [16], wherein at least one of the bonds linking the two antigen-binding domains is formed by linking amino acid residues present at different positions on the first antigen-binding domain and the second antigen-binding domain with each other.

[19] The antigen-binding molecule of any one of [1] to [18], wherein at least one of the first and second antigen-binding domains comprises an antibody fragment which binds to a particular antigen.

[20] The antigen-binding molecule of [19], wherein the antibody fragment is a Fab, Fab', scFab, Fv, scFv, or single domain antibody.

[21] The antigen-binding molecule of [19] or [20], wherein at least one of amino acid residues from which the bonds between the antigen-binding domains originate is present within the antibody fragment.

[22] The antigen-binding molecule of [21], wherein the amino acid residue from which the bonds between the antigen-binding domains originate is present within a constant region.

[23] The antigen-binding molecule of [22], wherein the constant region is derived from human.

[24] The antigen-binding molecule of [22] or [23], wherein the amino acid residue from which the bonds between the antigen-binding domains originate is present within a CH1 region.

[25] The antigen-binding molecule of [24], wherein the subclass of the CH1 region is γ1, γ2, 73, γ4, α1, α2, μ, δ, or ε.

[26] The antigen-binding molecule of [24] or [25], wherein the amino acid residue from which the bonds between the antigen-binding domains originate is present at any one of positions 119 to 123, 131 to 140, 148 to 150, 155 to 167, 174 to 178, 188 to 197, 201 to 214, and 218 to 219, according to EU numbering, in the CH1 region.

[27] The antigen-binding molecule of [26], wherein the amino acid residue from which the bonds between the antigen-binding domains originate is present at a position selected from the group consisting of positions 119, 122, 123, 131, 132, 133, 134, 135, 136, 137, 138, 139, 140, 148, 150, 155, 156, 157, 159, 160, 161, 162, 163, 164, 165, 167, 174, 176, 177, 178, 188, 189, 190, 191, 192, 193, 194, 195, 196, 197, 201, 203, 205, 206, 207, 208, 211, 212, 213, 214, 218, and 219, according to EU numbering, in the CH1 region.

[28] The antigen binding molecule of [27], wherein the amino acid residue from which the bonds between the antigen-binding domains originate is present at position 134, 135, 136, 137, 191, 192, 193, 194, 195, or 196, according to EU numbering, in the CH1 region.

[29] The antigen binding molecule of [28], wherein the amino acid residue from which the bonds between the antigen-binding domains originate is present at position 135, 136, or 191, according to EU numbering, in the CH1 region.

[30] The antigen binding molecule of any one of [24] to [29], wherein at least one of the bonds linking the two antigen-binding domains is formed by linking an amino acid residue in the CH1 region of the first antigen-binding domain with an amino acid residue in the CH1 region of the second antigen-binding domain.

[31] The antigen binding molecule of [30], wherein the amino acid residues in the first antigen-binding domain and the second antigen-binding domain are each independently selected from the group consisting of positions 119, 120, 121, 122, and 123 according to EU numbering.

[32] The antigen binding molecule of [30], wherein the amino acid residues in the first antigen-binding domain and the second antigen-binding domain are each independently selected from the group consisting of positions 131, 132, 133, 134, 135, 136, 137, 138, 139, and 140 according to EU numbering.

[33] The antigen binding molecule of [30], wherein the amino acid residues in the first antigen-binding domain and the second antigen-binding domain are each independently selected from the group consisting of positions 148, 149, and 150 according to EU numbering.

[34] The antigen binding molecule of [30], wherein the amino acid residues in the first antigen-binding domain and the second antigen-binding domain are each independently selected from the group consisting of positions 155, 156, 157, 158, 159, 160, 161, 162, 163, 164, 165, 166, and 167 according to EU numbering.

[35] The antigen binding molecule of [30], wherein the amino acid residues in the first antigen-binding domain and the second antigen-binding domain are each independently selected from the group consisting of positions 174, 175, 176, 177, and 178 according to EU numbering.

[36] The antigen binding molecule of [30], wherein the amino acid residues in the first antigen-binding domain and the second antigen-binding domain are each independently selected from the group consisting of positions 188, 189, 190, 191, 192, 193, 194, 195, 196, and 197 according to EU numbering.

[37] The antigen binding molecule of [30], wherein the amino acid residues in the first antigen-binding domain and the second antigen-binding domain are each independently selected from the group consisting of positions 201, 202, 203, 204, 205, 206, 207, 208, 209, 210, 211, 212, 213, and 214 according to EU numbering.

[38] The antigen binding molecule of [30], wherein the amino acid residues in the first antigen-binding domain and the second antigen-binding domain are each independently selected from the group consisting of positions 218 and 219 according to EU numbering.

[39] The antigen binding molecule of any one of [30] to [38], wherein the difference between the positions of the amino acid residues in the first antigen-binding domain and the second antigen-binding domain is three amino acids or less.

[40] The antigen-binding molecule of [39], wherein at least one of the bonds linking the two antigen-binding domains is formed by linking an amino acid residue at position 135 according to EU numbering in the CH1 region of the first antigen-binding domain with an amino acid residue at any one of positions 132 to 138 according to EU numbering in the CH1 region of the second antigen-binding domain.

[41] The antigen-binding molecule of [39], wherein at least one of the bonds linking the two antigen-binding domains is formed by linking an amino acid residue at position 136 according to EU numbering in the CH1 region of the first antigen-binding domain with an amino acid residue at any one of positions 133 to 139 according to EU numbering in the CH1 region of the second antigen-binding domain.

[42] The antigen-binding molecule of [39], wherein at least one of the bonds linking the two antigen-binding domains is formed by linking an amino acid residue at position 191 according to EU numbering in the CH1 region of the first antigen-binding domain with an amino acid residue at any one of positions 188 to 194 according to EU numbering in the CH1 region of the second antigen-binding domain.

[43] The antigen-binding molecule of [40], wherein at least one of the bonds linking the two antigen-binding domains is formed by linking amino acid residues at position 135 according to EU numbering in the CH1 region of the two antigen-binding domains with each other.

[44] The antigen-binding molecule of [41], wherein at least one of the bonds linking the two antigen-binding domains is formed by linking amino acid residues at position 136 according to EU numbering in the CH1 region of the two antigen-binding domains with each other.

[45] The antigen-binding molecule of [42], wherein at least one of the bonds linking the two antigen-binding domains is formed by linking amino acid residues at position 191 according to EU numbering in the CH1 region of the two antigen-binding domains with each other.

[46] The antigen-binding molecule of [22] or [23], wherein the amino acid residue from which the bonds between the antigen-binding domains originate is present within a CL region.

[47] The antigen-binding molecule of [46], wherein the subclass of the CL region is a or

[48] The antigen-binding molecule of [46] or [47], wherein the amino acid residue from which the bonds between the antigen-binding domains originate is present at any one of positions 108 to 112, 121 to 128, 151 to 156, 184 to 190, 195 to 196, 200 to 203, and 208 to 213, according to Kabat numbering, in the CL region.

[49] The antigen-binding molecule of [48], wherein the amino acid residue from which the bonds between the antigen-binding domains originate is present at a position selected from the group consisting of positions 108, 109, 112, 121, 123, 126, 128, 151, 152, 153, 156, 184, 186, 188, 189, 190, 195, 196, 200, 201, 202, 203, 208, 210, 211, 212, and 213 according to Kabat numbering in the CL region.

[50] The antigen-binding molecule of [49], wherein the amino acid residue from which the bonds between the antigen-binding domains originate is present at position 126 according to Kabat numbering in the CL region.

[51] The antigen-binding molecule of any one of [46] to [50], wherein at least one of the bonds linking the two antigen-binding domains is formed by linking an amino acid residue in the CL region of the first antigen-binding domain with an amino acid residue in the CL region of the second antigen-binding domain.

[52] The antigen-binding molecule of [51], wherein the amino acid residues in the first antigen-binding domain and the second antigen-binding domain are each independently selected from the group consisting of positions 108, 109, 110, 111, and 112 according to Kabat numbering.

[53] The antigen-binding molecule of [51], wherein the amino acid residues in the first antigen-binding domain and the second antigen-binding domain are each independently selected from the group consisting of positions 121, 122, 123, 124, 125, 126, 127, and 128 according to Kabat numbering.

[54] The antigen-binding molecule of [51], wherein the amino acid residues in the first antigen-binding domain and the second antigen-binding domain are each independently selected from the group consisting of positions 151, 152, 153, 154, 155, and 156 according to Kabat numbering.

[55] The antigen-binding molecule of [51], wherein the amino acid residues in the first antigen-binding domain and the second antigen-binding domain are each independently selected from the group consisting of positions 184, 185, 186, 187, 188, 189, and 190 according to Kabat numbering.

[56] The antigen-binding molecule of [51], wherein the amino acid residues in the first antigen-binding domain and the second antigen-binding domain are each independently selected from the group consisting of positions 195 and 196 according to Kabat numbering.

[57] The antigen-binding molecule of [51], wherein the amino acid residues in the first antigen-binding domain and the second antigen-binding domain are each independently selected from the group consisting of positions 200, 201, 202, and 203 according to Kabat numbering.

[58] The antigen-binding molecule of [51], wherein the amino acid residues in the first antigen-binding domain and the second antigen-binding domain are each independently selected from the group consisting of positions 208, 209, 210, 211, 212, and 213 according to Kabat numbering.

[59] The antigen-binding molecule of any one of [51] to [58], wherein the difference between the positions of the amino acid residues in the first antigen-binding domain and the second antigen-binding domain is three amino acids or less

[60] The antigen-binding molecule of [59], wherein at least one of the bonds linking the two antigen-binding domains is formed by linking amino acid residues at position 126 according to Kabat numbering in the CL region of the two antigen-binding domains with each other.

[61] The antigen-binding molecule of any one of [24] to [29] and [46] to [50], wherein at least one of the bonds linking the two antigen-binding domains is formed by linking an amino acid residue in the CH1 region of the first antigen-binding domain with an amino acid residue in the CL region of the second antigen-binding domain.

[62] The antigen-binding molecule of [61], wherein the amino acid residue in the CH1 region is selected from the group consisting of positions 188, 189, 190, 191, 192, 193, 194, 195, 196, and 197 according to EU numbering, and the amino acid residue in the CL region is selected from the group consisting of positions 121, 122, 123, 124, 125, 126, 127, and 128 according to Kabat numbering.

[63] The antigen-binding molecule of [62], wherein at least one of the bonds linking the two antigen-binding domains is formed by linking an amino acid residue at position 191 according to EU numbering in the CH1 region of the first antigen-binding domain with an amino acid residue at position 126 according to Kabat numbering in the CL region of the second antigen-binding domain.

[64] The antigen-binding molecule of [21], wherein the amino acid residue from which the bonds between the antigen-binding domains originate is present within a variable region.

[65] The antigen-binding molecule of [64], wherein the amino acid residue from which the bonds between the antigen-binding domains originate is present within a VH region.

[66] The antigen-binding molecule of [65], wherein the amino acid residue from which the bonds between the antigen-binding domains originate is present at a position selected from the group consisting of positions 6, 8, 16, 20, 25, 26, 28, 74, and 82b according to Kabat numbering in the VH region.

[67] The antigen-binding molecule of [64], wherein the amino acid residue from which the bonds between the antigen-binding domains originate is present within a VL region.

[68] The antigen-binding molecule of [67], wherein the amino acid residue from which the bonds between the antigen-binding domains originate is present at a position selected from the group consisting of positions 21, 27, 58, 77, 100, 105, and 107 according to Kabat numbering in the VL region (subclass K).

[69] The antigen-binding molecule of [67], wherein the amino acid residue from which the bonds between the antigen-binding domains originate is present at a position selected from the group consisting of positions 6, 19, 33, and 34 according to Kabat numbering in the VL region (subclass X).

[70] The antigen-binding molecule of [64], wherein the amino acid residue from which the bonds between the antigen-binding domains originate is present within a VHH region.

[71] The antigen-binding molecule of [70], wherein the amino acid residue from which the bonds between the antigen-binding domains originate is present at a position selected from the group consisting of positions 4, 6, 7, 8, 9, 10, 11, 12, 14, 15, 17, 20, 24, 27, 29, 38, 39, 40, 41, 43, 44, 45, 46, 47, 48, 49, 67, 69, 71, 78, 80, 82, 82c, 85, 88, 91, 93, 94, and 107 according to Kabat numbering in the VHH region.

[72] The antigen-binding molecule of any one of [1] to [18], wherein at least one of the first and second antigen-binding domains comprises a non-antibody protein binding to a particular antigen, or a fragment thereof.

[73] The antigen-binding molecule of [72], wherein the non-antibody protein is either of a pair of a ligand and a receptor which specifically bind to each other.

[74] The antigen-binding molecule of any one of [1] to [73], wherein the antigen-binding domains comprise a hinge region.

[75] The antigen-binding molecule of [74], wherein at least one of cysteine residues present within the wild-type hinge region is substituted with another amino acid residue.

[76] The antigen-binding molecule of [75], wherein the cysteine residue is present at positions 226 and/or 229 according to EU numbering in the hinge region.

[77] The antigen-binding molecule of [74] or [76], wherein at least one of amino acid residues from which the bonds between the antigen-binding domains originate is present within the hinge region.

[78] The antigen-binding molecule of [77], wherein the amino acid residue from which the bonds between the antigen-binding domains originate is present at a position selected from the group consisting of positions 216, 218, and 219 according to EU numbering in the hinge region.

[79] The antigen-binding molecule of any one of [1] to [78], wherein the first antigen-binding domain and the second antigen-binding domain are linked with each other via two or more bonds.

[80] The antigen-binding molecule of [79], wherein at least one of amino acid residues from which the bonds between the antigen-binding domains originate is an amino acid residue present in a wild-type sequence.

[81] The antigen-binding molecule of [80], wherein the amino acid residue from which the bonds between the antigen-binding domains originate is present within a hinge region.

[82] The antigen-binding molecule of [81], wherein the amino acid residue from which the bonds between the antigen-binding domains originate is a cysteine residue in the hinge region.

[83] The antigen-binding molecule of any one of [80] to [82], wherein at least one of the bonds linking the two antigen-binding domains is a disulfide bond formed by crosslinking of cysteine residues present within the hinge region with each other.

[84] The antigen-binding molecule of [83], wherein the cysteine residues are present at positions 226 and/or 229 according to EU numbering in the hinge region.

[85] The antigen-binding molecule of any one of [79] to [84], wherein at least one of amino acid residues from which the bonds between the antigen-binding domains originate is present within the antibody fragment, and at least one of the amino acid residues is present within the hinge region.

[86] The antigen-binding molecule of [85], wherein the first and second antigen-binding domains each comprise a Fab and a hinge region, and wherein the antigen-binding molecule comprising the two antigen-binding domains is F(ab')2.

[87] The antigen-binding molecule of any one of [1] to [86], wherein the antigen-binding domains comprise an Fc region.

[88] The antigen-binding molecule of [87], wherein one or more amino acid mutations promoting multimerization of Fc regions are introduced into the Fc region.

[89] The antigen-binding molecule of [88], wherein the amino acid mutations promoting the multimerization comprise an amino acid mutation at at least one position selected from the group consisting of positions 247, 248, 253, 254, 310, 311, 338, 345, 356, 359, 382, 385, 386, 430, 433, 434, 436, 437, 438, 439, 440, and 447 according to EU numbering.

[90] The antigen-binding molecule of [88] or [89], wherein the multimerization is hexamerization.

[91] The antigen-binding molecule of any one of [87] to [90], which is a full-length antibody.

[0014][92] The antigen-binding molecule of any one of [1] to [91], wherein both the first and second antigen-binding domains bind to the same antigen.

[93] The antigen-binding molecule of [92], wherein both the first and second antigen-binding domains bind to the same epitope on said antigen.

[94] The antigen-binding molecule of [92], wherein each of the first and second antigen-binding domains binds to a different epitope on said antigen.

[95] The antigen-binding molecule of any one of [1] to [91], wherein each of the first and second antigen-binding domains binds to a different antigen.

[96] The antigen-binding molecule of [93], wherein both the first and second antigen-binding domains have the same amino acid sequence.

[97] The antigen-binding molecule of any one of [93] to [95], wherein each of the first and second antigen-binding domains has a different amino acid sequence.

[98] The antigen-binding molecule of any one of [1] to [91], wherein at least one of two antigens to which the first and second antigen-binding domains bind is a soluble protein.

[99] The antigen-binding molecule of any one of [1] to [91], wherein at least one of two antigens to which the first and second antigen-binding domains bind is a membrane protein.

[100] The antigen-binding molecule of any one of [1] to [99], which has activity of regulating interaction between two antigen molecules.

[101] The antigen-binding molecule of [100], which is capable of enhancing or diminishing interaction between two antigen molecules as compared to a control antigen-binding molecule, wherein the control antigen-binding molecule differs from the antigen-binding molecule of [100] only in that the control antigen-binding molecule has one less bond between the two antigen-binding domains.

[102] The antigen-binding molecule of [100] or [101], wherein the two antigen molecules are a ligand and a receptor thereof, respectively, and wherein the antigen-binding molecule has activity of promoting activation of the receptor by the ligand.

[103] The antigen-binding molecule of [100] or [101], wherein the two antigen molecules are an enzyme and a substrate thereof, respectively, and wherein the antigen-binding molecule has activity of promoting catalytic reaction of the enzyme with the substrate.

[104] The antigen-binding molecule of [100] or [101], wherein both of the two antigen molecules are proteins present on cellular surfaces, and wherein the antigen-binding molecule has activity of promoting interaction between a cell expressing the first antigen and a cell expressing the second antigen.

[105] The antigen-binding molecule of [104], wherein the cell expressing the first antigen is a cell with cytotoxic activity, and the cell expressing the second antigen is a target cell thereof, and wherein the antigen-binding molecule promotes damage of said target cell by said cell with cytotoxic activity.

[106] The antigen-binding molecule of [105], wherein the cell with cytotoxic activity is a T cell, NK cell, monocyte, or macrophage.

[107] The antigen-binding molecule of any one of [1] to [99], which has activity of regulating activation of two antigen molecules which are activated by association with each other.

[108] The antigen-binding molecule of [107], which enhances or diminishes activation of two antigen molecules as compared to a control antigen-binding molecule, wherein the control antigen-binding molecule differs from the antigen-binding molecule of [107] only in that the control antigen-binding molecule has one less bond between the two antigen-binding domains.

[109] The antigen-binding molecule of [107] or [108], wherein the antigen molecules are selected from the group consisting of receptors belonging to cytokine receptor superfamilies, G protein-coupled receptors, ion channel receptors, tyrosine kinase receptors, immune checkpoint receptors, antigen receptors, CD antigens, costimulatory molecules, and cell adhesion molecules.

[110] The antigen-binding molecule of any one of [1] to [99], which has activity of holding two antigen molecules at spatially close positions.

[111] The antigen-binding molecule of [110], which is capable of holding two antigen molecules at closer positions than a control antigen-binding molecule, wherein the control antigen-binding molecule differs from the antigen-binding molecule of [110] only in that the control antigen-binding molecule has one less bond between the two antigen-binding domains.

[112] The antigen-binding molecule of any one of [1] to [99], wherein the two antigen-binding domains are at spatially close positions and/or the mobility of the two antigen-binding domains is reduced.

[113] The antigen-binding molecule of [112], wherein the two antigen-binding domains are at closer positions and/or the two antigen-binding domains have less mobility than a control antigen-binding molecule, wherein the control antigen-binding molecule differs from the antigen-binding molecule of [112] only in that the control antigen-binding molecule has one less bond between the two antigen-binding domains.

[114] The antigen-binding molecule of any one of [1] to [99], which has resistance to protease cleavage.

[115] The antigen-binding molecule of [114], which has increased resistance to protease cleavage as compared to a control antigen-binding molecule, wherein the control antigen-binding molecule differs from the antigen-binding molecule of [114] only in that the control antigen-binding molecule has one less bond between the two antigen-binding domains.

[116] The antigen-binding molecule of [115], wherein the proportion of the full length molecule remaining after protease treatment is increased as compared to the control antigen-binding molecule.

[117] The antigen-binding molecule of [115] or [116], wherein the proportion of a particular fragment produced after protease treatment is reduced as compared to the control antigen-binding molecule.

[118] The antigen-binding molecule of any one of [1] to [99], wherein when the molecule is treated with a protease, a dimer of the antigen-binding domains or fragments thereof is excised.

[119] The antigen-binding molecule of [118], wherein when the control antigen-binding molecule is treated with said protease, monomers of the antigen-binding domains or fragments thereof are excised, and wherein the control antigen-binding molecule differs from the antigen-binding molecule of [118] only in that the control antigen-binding molecule has one less bond between the two antigen-binding domains.

[120] The antigen-binding molecule of [118] or [119], wherein the protease cleaves the hinge region.

[121] The antigen binding molecule of any one of [101] to [106], [108] to [109], [111], [113], [115] to [117], and [119] to [120], wherein the one less bond is a bond formed originating from a mutated amino acid residue.

[122] The antigen-binding molecule of [121], wherein the mutated amino acid residue is a cysteine residue.

[123] A pharmaceutical composition comprising the antigen-binding molecule of any one of [1] to [122] and a pharmaceutically acceptable carrier.

[124] A method for regulating interaction between two antigen molecules, comprising:
 (a) providing an antigen-binding molecule comprising two antigen-binding domains,
 (b) adding to the antigen-binding molecule at least one bond which links the two antigen-binding domains with each other, and
 (c) contacting the antigen-binding molecule produced in (b) with the two antigen molecules.

[125] A method for regulating activity of two antigen molecules which are activated by association with each other, comprising:
 (a) providing an antigen-binding molecule comprising two antigen-binding domains,
 (b) adding to the antigen-binding molecule at least one bond which links the two antigen-binding domains with each other, and
 (c) contacting the antigen-binding molecule produced in (b) with the two antigen molecules.

[126] A method for holding two antigen molecules at spatially close positions, comprising:
 (a) providing an antigen-binding molecule comprising two antigen-binding domains,
 (b) adding to the antigen-binding molecule at least one bond which links the two antigen-binding domains with each other, and
 (c) contacting the antigen-binding molecule produced in (b) with the two antigen molecules.

[127] A method for placing two antigen-binding domains at spatially close positions and/or reducing the mobility of the two antigen-binding domains, comprising:
 (a) providing an antigen-binding molecule comprising two antigen-binding domains, and
 (b) adding to the antigen-binding molecule at least one bond which links the two antigen-binding domains with each other.

[128] A method for increasing resistance of an antigen-binding molecule to protease cleavage, comprising:
 (a) providing an antigen-binding molecule comprising two antigen-binding domains, and
 (b) adding to the antigen-binding molecule at least one bond which links the two antigen-binding domains with each other.

[0018][129] A method for producing an antigen-binding molecule which has activity of regulating interaction between two antigen molecules, comprising:
 (a) providing a nucleic acid encoding a polypeptide comprising a first antigen-binding domain and a nucleic acid encoding a polypeptide comprising a second antigen-binding domain,
 (b) introducing a mutation into the nucleic acids encoding the two antigen-binding domains such that at least one bond linking the two antigen-binding domains is added,
 (c) introducing the nucleic acids produced in (b) into a host cell,
 (d) culturing the host cell such that the two polypeptides are expressed, and
 (e) obtaining an antigen-binding molecule which is a polypeptide comprising the first and second antigen-binding domains, wherein the two antigen-binding domains are linked with each other via one or more bonds.

[130] A method for producing an antigen-binding molecule which has activity of regulating activation of two antigen molecules which are activated by association with each other, comprising:
 (a) providing a nucleic acid encoding a polypeptide comprising a first antigen-binding domain and a nucleic acid encoding a polypeptide comprising a second antigen-binding domain,
 (b) introducing a mutation into the nucleic acids encoding the two antigen-binding domains such that at least one bond linking the two antigen-binding domains is added,
 (c) introducing the nucleic acids produced in (b) into a host cell,
 (d) culturing the host cell such that the two polypeptides are expressed, and
 (e) obtaining an antigen-binding molecule which is a polypeptide comprising the first and second antigen-binding domains, wherein the two antigen-binding domains are linked with each other via one or more bonds.

[131] A method for producing an antigen-binding molecule which has activity of holding two antigen molecules at spatially close positions, comprising:
 (a) providing a nucleic acid encoding a polypeptide comprising a first antigen-binding domain and a nucleic acid encoding a polypeptide comprising a second antigen-binding domain,
 (b) introducing a mutation into the nucleic acids encoding the two antigen-binding domains such that at least one bond linking the two antigen-binding domains is added,
 (c) introducing the nucleic acids produced in (b) into a host cell,
 (d) culturing the host cell such that the two polypeptides are expressed, and
 (e) obtaining an antigen-binding molecule which is a polypeptide comprising the first and second antigen-binding domains, wherein the two antigen-binding domains are linked with each other via one or more bonds.

[132] A method for producing an antigen-binding molecule in which two antigen-binding domains are present at spatially close positions and/or the mobility of the two antigen binding domains is reduced, comprising:
 (a) providing a nucleic acid encoding a polypeptide comprising a first antigen-binding domain and a nucleic acid encoding a polypeptide comprising a second antigen-binding domain,
 (b) introducing a mutation into the nucleic acids encoding the two antigen-binding domains such that at least one bond linking the two antigen-binding domains is added, (c) introducing the nucleic acids produced in (b) into a host cell,
(d) culturing the host cell such that the two polypeptides are expressed, and
(e) obtaining an antigen-binding molecule which is a polypeptide comprising the first and second antigen-binding domains, wherein the two antigen-binding domains are linked with each other via one or more bonds.

[133] A method for producing an antigen-binding molecule which has increased resistance to protease cleavage, comprising:
(a) providing a nucleic acid encoding a polypeptide comprising a first antigen-binding domain and a nucleic acid encoding a polypeptide comprising a second antigen-binding domain,
(b) introducing a mutation into the nucleic acids encoding the two antigen-binding domains such that at least one bond linking the two antigen-binding domains is added,
(c) introducing the nucleic acids produced in (b) into a host cell,
(d) culturing the host cell such that the two polypeptides are expressed, and
(e) obtaining an antigen-binding molecule which is a polypeptide comprising the first and second antigen-binding domains, wherein the two antigen-binding domains are linked with each other via one or more bonds.

[0019][134] A method for identifying a novel pair of protein molecules which are activated by association with each other, comprising:
(a) providing two arbitrary protein molecules,
(b) producing, by the method of any one of [129] to [133], an antigen-binding molecule comprising two antigen-binding domains which respectively bind to the two protein molecules,
(c) contacting the antigen-binding molecule produced in (b) with the two protein molecules, and
(d) assessing whether or not the two protein molecules are activated.

[135] The method of [134], wherein at least one of the protein molecules is selected from the group consisting of receptors belonging to cytokine receptor superfamilies, G protein-coupled receptors, ion channel receptors, tyrosine kinase receptors, immune checkpoint receptors, antigen receptors, CD antigens, costimulatory molecules, and cell adhesion molecules.

BRIEF DESCRIPTION OF DRAWINGS

FIG. 31A shows the agonist activity of an anti-CD3×anti-PD1 bispecific antibody molecule (OKT3//117-G1silent) which is composed of an anti-CD3 antibody (OKT3) and an anti-PD1 antibody (117), and modified antibody molecules produced by linking the Fab-Fab of that antibody molecule via an additional disulfide bond (OKT3//117-G1silentHH, OKT3//117-G1silentHL, OKT3//117-G1silentLL).

FIG. 31B shows the agonist activity of an anti-CD3×anti-PD1 bispecific antibody molecule (OKT3//10-G1silent) which is composed of an anti-CD3 antibody (OKT3) and an anti-PD1 antibody (10), and modified antibody molecules produced by linking the Fab-Fab of that antibody molecule via an additional disulfide bond (OKT3//10-G1silentHH, OKT3//10-G1silentHL).

FIG. 31C shows the agonist activity of an anti-CD3×anti-PD1 bispecific antibody molecule (CD3//949-G1silent) which is composed of an anti-CD3 antibody (CD3) and an anti-PD1 antibody (949), and modified antibody molecules produced by linking the Fab-Fab of that antibody molecule via an additional disulfide bond (CD3//949-G1silentLH, CD3//949-G1silentHH, CD3//949-G1silentLL, CD3//949-G1silentHL).

FIG. 31D shows the agonist activity of an anti-CD3×anti-PD1 bispecific antibody molecule (OKT3//949-G1silent) which is composed of an anti-CD3 antibody (OKT3) and an anti-PD1 antibody (949), and modified antibody molecules produced by linking the Fab-Fab of that antibody molecule via an additional disulfide bond (OKT3//949-G1silentHL, OKT3//949-G1silentHH, OKT3//949-G1silentLL).

FIG. 33A shows the inhibitory effect on cancer cell growth when a GPC3/binding-attenuated CD3 bispecific antibody molecule (GPC3/attCE115) was used as an antibody to target T cells to cancer cells, and a GPC3/CD3 clamping bispecific antibody molecule (GPC3/clamp CD3), a KLH/CD3 clamping bispecific antibody molecule (KLH/clamp CD3), a CD28/CD3 clamping bispecific antibody molecule (CD28/clamp CD3), or a modified antibody molecule produced by linking the Fab-Fab of that antibody molecule via an additional disulfide bond (CD28/clamp CD3_HH) was used as an antibody for activating T cells.

FIG. 34A shows the level of IL-6 production when a GPC3/binding-attenuated CD3 bispecific antibody molecule (GPC3/attCE115) and a modified antibody molecule produced by linking the Fab-Fab of the CD28/CD3 clamping bispecific antibody via an additional disulfide bond (CD28/clamp CD3_HH) were used each alone or in combination in the presence of target cells (GPC3-expressing cancer cells) and effector cells (T cells).

FIG. 34B shows the level of IL-6 production when a GPC3/binding-attenuated CD3 bispecific antibody molecule (GPC3/attCE115) and a modified antibody molecule produced by linking the Fab-Fab of the CD28/CD3 clamping bispecific antibody via an additional disulfide bond (CD28/clamp CD3_HH) were used each alone or in combination in the presence of effector cells (T cells) only.

FIG. 34C shows the cancer cell growth inhibitory effect when a GPC3/binding-attenuated CD3 bispecific antibody molecule (GPC3/attCE115) and a modified antibody molecule produced by linking the Fab-Fab of the CD28/CD3 clamping bispecific antibody via an additional disulfide bond (CD28/clamp CD3_HH) were used each alone or in combination in the presence of target cells (GPC3-expressing cancer cells) and effector cells (T cells).

FIG. 35A shows the mechanism of action of the cancer cell growth inhibition when a CD28/CD3 clamping bispecific antibody and a GPC3/binding-attenuated CD3 bispecific antibody are used in combination in the presence of target cells (GPC3-expressing cancer cells) and effector cells (T cells).

FIG. 36A shows the mechanism of action of the cytokine production when a modified antibody molecule which has been modified to introduce an additional disulfide bond into the Fab-Fab of a CD28/CD3 clamping bispecific antibody, and a GPC3/binding-attenuated CD3 bispecific antibody, are used in combination in the presence of target cells (GPC3-expressing cancer cells) and effector cells (T cells).

FIG. 37A shows the proportion of divided regulatory T cells (Treg) in PBMCs.

DESCRIPTION OF EMBODIMENTS

I. Definitions

Figure 1:
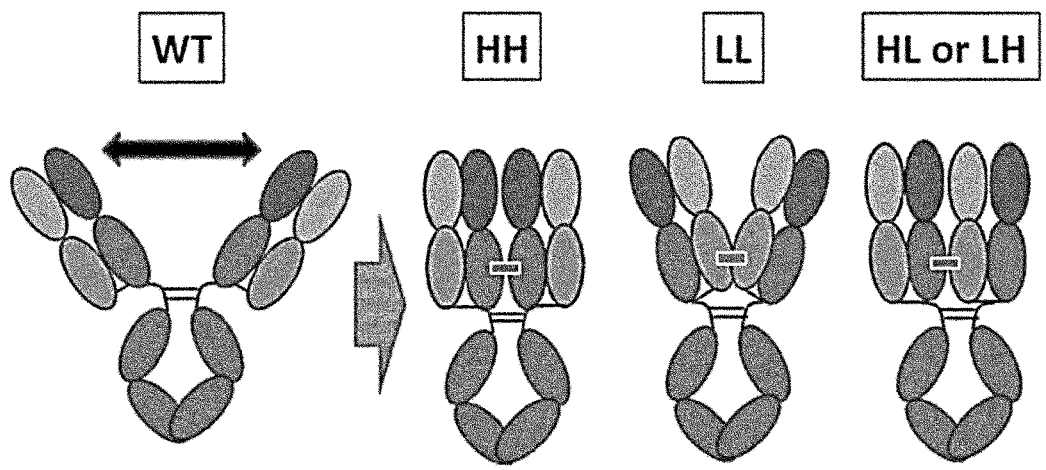
FIG. 1 depicts examples of modified antibodies in which the Fabs are crosslinked with each other as described in Example 1. The figure schematically shows structural differences between a wild-type antibody (WT) and a modified antibody in which the CH1 regions of antibody H chain are crosslinked with each other (HH type), a modified antibody in which the CL regions of antibody L chain are crosslinked with each other (LL type), and a modified antibody in which the CH1 region of antibody H chain is crosslinked with the CL region of antibody L chain (HL or LH type).

Herein, the term "antigen-binding molecule" refers, in its broadest sense, to a molecule that specifically binds to an antigenic determinant (epitope). In one embodiment, the antigen-binding molecule is an antibody, antibody fragment, or antibody derivative. In one embodiment, the antigen-binding molecule is a non-antibody protein, or a fragment thereof, or a derivative thereof.

Herein, "antigen-binding domain" refers to a region that specifically binds and is complementary to the whole or a portion of an antigen. Herein, an antigen-binding molecule comprises an antigen-binding domain. When the molecular weight of an antigen is large, an antigen-binding domain can only bind to a particular portion of the antigen. The particular portion is called "epitope". In one embodiment, an antigen-binding domain comprises an antibody fragment which binds to a particular antigen. An antigen-binding domain can be provided from one or more antibody variable domains. In a non-limiting embodiment, the antigen-binding domains comprise both the antibody light chain variable region (VL) and antibody heavy chain variable region (VH). Examples of such antigen-binding domains include "single-chain Fv (scFv)", "single-chain antibody", "Fv", "single-chain Fv2 (scFv2)", "Fab", and "Fab'". In other embodiments, an antigen-binding domain comprises a non-antibody protein which binds to a particular antigen, or a fragment thereof. In a specific embodiment, an antigen-binding domain comprises a hinge region.

In the present invention, "specifically binds" means binding in a state where one of the molecules involved in specific binding does not show any significant binding to molecules other than a single or a number of binding partner molecules. Furthermore, it is also used when an antigen-binding domain is specific to a particular epitope among multiple epitopes contained in an antigen. When an epitope bound by an antigen-binding domain is contained in multiple different antigens, antigen-binding molecules comprising the antigen-binding domain can bind to various antigens that have the epitope.

In the present disclosure, the recitation "binds to the same epitope" means that the epitopes to which two antigen-binding domains bind at least partially overlap each other. The degree of the overlap is, but not limited to, at least 10% or more, preferably 20% or more, 30% or more, 40% or more, 50% or more, 60% or more, 70% or more, and 80% or more, particularly preferably 90% or more, and most preferably 100%.

The term "antibody" herein is used in the broadest sense and encompasses various antibody structures, including but not limited to monoclonal antibodies, polyclonal antibodies, multispecific antibodies (e.g., bispecific antibodies), and antibody fragments so long as they exhibit the desired antigen-binding activity.

The term "monoclonal antibody" as used herein refers to an antibody obtained from a population of substantially homogeneous antibodies, i.e., the individual antibodies composing the population are identical and/or bind the same epitope, except for possible variant antibodies, e.g., containing naturally occurring mutations or arising during production of a monoclonal antibody preparation, such variants generally being present in minor amounts. In contrast to polyclonal antibody preparations, which typically include different antibodies directed against different determinants (epitopes), each monoclonal antibody of a monoclonal antibody preparation is directed against a single determinant on an antigen. Thus, the modifier "monoclonal" indicates the character of the antibody as being obtained from a substantially homogeneous population of antibodies, and is not to be construed as requiring production of the antibody by any particular method. For example, the monoclonal antibodies to be used in accordance with the present invention may be made by a variety of techniques, including but not limited to the hybridoma method, recombinant DNA methods, phage-display methods, and methods utilizing transgenic animals containing all or part of the human immunoglobulin loci, such methods and other exemplary methods for making monoclonal antibodies being described herein.

"Native antibodies" refer to naturally occurring immunoglobulin molecules with varying structures. For example, native IgG antibodies are heterotetrameric glycoproteins of about 150,000 daltons, composed of two identical light chains and two identical heavy chains that are disulfide-bonded. From N- to C-terminus, each heavy chain has a variable region (VH), also called a variable heavy domain or a heavy chain variable domain, followed by three constant domains (CH1, CH2, and CH3). Similarly, from N- to C-terminus, each light chain has a variable region (VL), also called a variable light domain or a light chain variable domain, followed by a constant light (CL) domain. The light chain of an antibody may be assigned to one of two types, called kappa (u) and lambda (k), based on the amino acid sequence of its constant domain.

The term "chimeric" antibody refers to an antibody in which a portion of the heavy and/or light chain is derived from a particular source or species, while the remainder of the heavy and/or light chain is derived from a different source or species.

The "class" of an antibody refers to the type of constant domain or constant region possessed by its heavy chain. There are five major classes of antibodies: IgA, IgD, IgE, IgG, and IgM, and several of these may be further divided into subclasses (isotypes), e.g., IgG1, IgG2, IgG3, IgG4, IgA1, and IgA2. The heavy chain constant domains that correspond to the different classes of immunoglobulins are called alpha, delta, epsilon, gamma, and mu, respectively.

In one embodiment of the present invention, constant regions are preferably antibody constant regions, more preferably IgG1, IgG2, IgG3, and IgG4-type antibody constant regions, and even more preferably human IgG1, IgG2, IgG3, and IgG4-type antibody constant regions. Furthermore, in another embodiment of the present invention, constant regions are preferably heavy chain constant regions, more preferably IgG1, IgG2, IgG3, and IgG4-type heavy chain constant regions, and even more preferably human IgG1, IgG2, IgG3, and IgG4-type heavy chain constant regions. The amino acid sequences of the human IgG1 constant region, the human IgG2 constant region, the human IgG3 constant region, and the human IgG4 constant region are known. For the constant regions of human IgG1, human IgG2, human IgG3, and human IgG4, a plurality of allotype sequences with genetic polymorphism are described in Sequences of proteins of immunological interest, NIH Publication No. 91-3242, and any of them can be used in the present invention. Amino acid-modified constant regions of the present invention may contain other amino acid mutations or modifications, as long as they include an amino acid mutation of the present invention.

The term "hinge region" denotes an antibody heavy chain polypeptide portion in a wild-type antibody heavy chain that joins the CH1 domain and the CH2 domain, e.g., from about position 216 to about position 230 according to the EU numbering system, or from about position 226 to about position 243 according to the Kabat numbering system. It is known that in a native IgG antibody, cysteine residue at position 220 according to EU numbering in the hinge region forms a disulfide bond with cysteine residue at position 214 in the antibody light chain. It is also known that between the two antibody heavy chains, disulfide bonds are formed between cysteine residues at position 226 and between cysteine residues at position 229 according to EU numbering in the hinge region. A hinge region herein includes wild-type hinge regions as well as variants in which amino acid residue(s) in a wild-type hinge region is altered by substitution, addition, or deletion.

The term "Fc region" herein is used to define a C-terminal region of an immunoglobulin heavy chain that contains at least a portion of the constant region. The term includes native sequence Fc regions and variant Fc regions. In one embodiment, a human IgG heavy chain Fc region extends from Cys226, or from Pro230, to the carboxyl-terminus of the heavy chain. However, the C-terminal lysine (Lys447) or glycine-lysine (residues 446-447) of the Fc region may or may not be present. Unless otherwise specified herein, numbering of amino acid residues in the Fc region or constant region is according to the EU numbering system, also called the EU index, as described in Kabat et al., Sequences of Proteins of Immunological Interest, 5th Ed. Public Health Service, National Institutes of Health, Bethesda, MD, 1991.

"Effector functions" refer to those biological activities attributable to the Fc region of an antibody, which vary with the antibody isotype. Examples of antibody effector functions include: C1q binding and complement dependent cytotoxicity (CDC); Fc receptor binding; antibody-dependent cell-mediated cytotoxicity (ADCC); phagocytosis; down regulation of cell surface receptors (e.g. B cell receptor); and B cell activation.

The term "Fc receptor" or "FcR" refers to a receptor that binds to the Fc region of an antibody. In some embodiments, an FcR is a native human FcR. In some embodiments, an FcR is one which binds an IgG antibody (a gamma receptor) and includes receptors of the Fc gamma RI, Fc gamma RII, and Fc gamma RIII subclasses, including allelic variants and alternatively spliced forms of those receptors. Fc gamma RII receptors include Fc gamma RIIA (an "activating receptor") and Fc gamma RIIB (an "inhibiting receptor"), which have similar amino acid sequences that differ primarily in the cytoplasmic domains thereof. Activating receptor Fc gamma RIIA contains an immunoreceptor tyrosine-based activation motif (ITAM) in its cytoplasmic domain. Inhibiting receptor Fc gamma RIIB contains an immunoreceptor tyrosine-based inhibition motif (ITIM) in its cytoplasmic domain. (see, e.g., Dafron, Annu. Rev. Immunol. 15:203-234 (1997)). FcRs are reviewed, for example, in Ravetch and Kinet, Annu. Rev. Immunol 9:457-92 (1991); Capel et al., Immunomethods 4:25-34 (1994); and de Haas et al., J. Lab. Clin. Med. 126:330-41 (1995). Other FcRs, including those to be identified in the future, are encompassed by the term "FcR" herein.

The term "Fc receptor" or "FcR" also includes the neonatal receptor, FcRn, which is responsible for the transfer of maternal IgGs to the fetus (Guyer et al., *J. Immunol.* 117:587 (1976) and Kim et al., *J. Immunol.* 24:249 (1994)) and regulation of homeostasis of immunoglobulins. Methods of measuring binding to FcRn are known (see, e.g., Ghetie and Ward., Immunol. Today 18(12):592-598 (1997); Ghetie et al., Nature Biotechnology, 15(7):637-640 (1997); Hinton et al., J. Biol. Chem. 279(8):6213-6216 (2004); WO 2004/92219 (Hinton et al.).

The term "variable region" or "variable domain" refers to the domain of an antibody heavy or light chain that is involved in binding the antibody to antigen. The variable domains of the heavy chain and light chain (VH and VL, respectively) of a native antibody generally have similar structures, with each domain comprising four conserved framework regions (FRs) and three hypervariable regions (HVRs). (See, e.g., Kindt et al. Kuby Immunology, 6th ed., W. H. Freeman and Co., page 91 (2007).) A single VH or VL domain may be sufficient to confer antigen-binding specificity. Furthermore, antibodies that bind a particular antigen may be isolated using a VH or VL domain from an antibody that binds the antigen to screen a library of complementary VL or VH domains, respectively. See, e.g., Portolano et al., *J. Immunol.* 150:880-887 (1993); Clarkson et al., *Nature* 352:624-628 (1991).

The term "hypervariable region" or "HVR" as used herein refers to each of the regions of an antibody variable domain which are hypervariable in sequence ("complementarity determining regions" or "CDRs") and/or form structurally defined loops ("hypervariable loops") and/or contain the antigen-contacting residues ("antigen contacts"). Generally, antibodies comprise six HVRs: three in the VH (H1, H2, H3), and three in the VL (L1, L2, L3). Exemplary HVRs herein include:
 (a) hypervariable loops occurring at amino acid residues 26-32 (L1), 50-52 (L2), 91-96 (L3), 26-32 (H1), 53-55 (H2), and 96-101 (H3) (Chothia and Lesk, J. Mol. Biol. 196:901-917 (1987));
 (b) CDRs occurring at amino acid residues 24-34 (L1), 50-56 (L2), 89-97 (L3), 31-35b (H1), 50-65 (H2), and 95-102 (H3) (Kabat et al., Sequences of Proteins of Immunological Interest, 5th Ed. Public Health Service, National Institutes of Health, Bethesda, MD (1991));
 (c) antigen contacts occurring at amino acid residues 27c-36 (L1), 46-55 (L2), 89-96 (L3), 30-35b (H1), 47-58 (H2), and 93-101 (H3) (MacCallum et al. J. Mol. Biol. 262: 732-745 (1996)); and
 (d) combinations of (a), (b), and/or (c), including HVR amino acid residues 46-56 (L2), 47-56 (L2), 48-56 (L2), 49-56 (L2), 26-35 (H1), 26-35b (H1), 49-65 (H2), 93-102 (H3), and 94-102 (H3).

Unless otherwise indicated, HVR residues and other residues in the variable domain (e.g., FR residues) are numbered herein according to Kabat et al., supra.

"Framework" or "FR" refers to variable domain residues other than hypervariable region (HVR) residues. The FR of a variable domain generally consists of four FR domains: FR1, FR2, FR3, and FR4. Accordingly, the HVR and FR sequences generally appear in the following sequence in VH (or VL): FR1-H1(L1)-FR2-H2(L2)-FR3-H3(L3)-FR4.

The terms "full length antibody," "intact antibody," and "whole antibody" are used herein interchangeably to refer to an antibody having a structure substantially similar to a native antibody structure or having heavy chains that contain an Fc region as defined herein.

The terms "host cell," "host cell line," and "host cell culture" are used interchangeably and refer to cells into which exogenous nucleic acid has been introduced, including the progeny of such cells. Host cells include "transformants" and "transformed cells," which include the primary transformed cell and progeny derived therefrom without regard to the number of passages. Progeny may not be completely identical in nucleic acid content to a parent cell, but may contain mutations. Mutant progeny that have the same function or biological activity as screened or selected for in the originally transformed cell are included herein.

The term "vector," as used herein, refers to a nucleic acid molecule capable of propagating another nucleic acid to which it is linked. The term includes the vector as a self-replicating nucleic acid structure as well as the vector incorporated into the genome of a host cell into which it has been introduced. Certain vectors are capable of directing the expression of nucleic acids to which they are operatively linked. Such vectors are referred to herein as "expression vectors."

A "human antibody" is one which possesses an amino acid sequence which corresponds to that of an antibody produced by a human or a human cell or derived from a non-human source that utilizes human antibody repertoires or other human antibody-encoding sequences. This definition of a human antibody specifically excludes a humanized antibody comprising non-human antigen-binding residues.

A "humanized" antibody refers to a chimeric antibody comprising amino acid residues from non-human HVRs and amino acid residues from human FRs. In certain embodiments, a humanized antibody will comprise substantially all of at least one, and typically two, variable domains, in which all or substantially all of the HVRs (e.g., CDRs) correspond to those of a non-human antibody, and all or substantially all of the FRs correspond to those of a human antibody. A humanized antibody optionally may comprise at least a portion of an antibody constant region derived from a human antibody. A "humanized form" of an antibody, e.g., a non-human antibody, refers to an antibody that has undergone humanization.

An "antibody fragment" refers to a molecule other than an intact antibody that comprises a portion of an intact antibody that binds the antigen to which the intact antibody binds. Examples of antibody fragments include but are not limited to Fv, Fab, Fab', Fab'-SH, F(ab')2; diabodies; linear antibodies; single-chain antibody molecules (e.g. scFv); single chain Fabs (scFabs); single domain antibodies; and multispecific antibodies formed from antibody fragments.

Variable Fragment (Fv)

Herein, the term "variable fragment (Fv)" refers to the minimum unit of an antibody-derived antigen-binding domain that is composed of a pair of the antibody light chain variable region (VL) and antibody heavy chain variable region (VH). In 1988, Skerra and Pluckthun found that homogeneous and active antibodies can be prepared from the *E. coli* periplasm fraction by inserting an antibody gene downstream of a bacterial signal sequence and inducing expression of the gene in *E. coli* (Science (1988) 240(4855), 1038-1041). In the Fv prepared from the periplasm fraction, VH associates with VL in a manner so as to bind to an antigen.

scFv, Single-Chain Antibody, and Sc(Fv)2

Herein, the terms "scFv", "single-chain antibody", and "sc(Fv)2" all refer to an antibody fragment of a single polypeptide chain that contains variable regions derived from the heavy and light chains, but not the constant region. In general, a single-chain antibody also contains a polypeptide linker between the VH and VL domains, which enables formation of a desired structure that is thought to allow antigen binding. The single-chain antibody is discussed in detail by Pluckthun in "The Pharmacology of Monoclonal Antibodies, Vol. 113, Rosenburg and Moore, eds., Springer-Verlag, New York, 269-315 (1994)". See also International Patent Publication WO 1988/001649; U.S. Pat. Nos. 4,946, 778 and 5,260,203. In a particular embodiment, the single-chain antibody can be bispecific and/or humanized.

scFv is an antigen-binding domain in which VH and VL forming Fv are linked together by a peptide linker (Proc. Natl. Acad. Sci. U.S.A. (1988) 85(16), 5879-5883). VH and VL can be retained in close proximity by the peptide linker.

sc(Fv)2 is a single-chain antibody in which four variable regions of two VL and two VH are linked by linkers such as peptide linkers to form a single chain (J Immunol. Methods (1999) 231(1-2), 177-189). The two VH and two VL may be derived from different monoclonal antibodies. Such sc(Fv)2 preferably includes, for example, a bispecific sc(Fv)2 that recognizes two epitopes present in a single antigen as disclosed in the Journal of Immunology (1994) 152(11), 5368-5374. sc(Fv)2 can be produced by methods known to those skilled in the art. For example, sc(Fv)2 can be produced by linking scFv by a linker such as a peptide linker.

Herein, the form of an antigen-binding domain forming an sc(Fv)2 include an antibody in which the two VH units and two VL units are arranged in the order of VH, VL, VH, and VL ([VH]-linker-[VL]-linker-[VH]-linker-[VL]) beginning from the N terminus of a single-chain polypeptide. The order of the two VH units and two VL units is not limited to the above form, and they may be arranged in any order. Example order of the form is listed below.

[VL]-linker-[VH]-linker-[VH]-linker-[VL][VH]-linker-[VL]-linker-[VL]-linker-[VH][VH]-linker-[VH]-linker-[VL]-linker-[VL][VL]-linker-[VL]-linker-[VH]-linker-[VH][VL]-linker-[VH]-linker-[VL]-linker-[VH]

Fab, F(ab')2 and Fab'

"Fab" consists of a single light chain, and a CH1 region and variable region from a single heavy chain. The heavy chain of a wild-type Fab molecule cannot form disulfide bonds with another heavy chain molecule. Herein, in addition to wild-type Fab molecules, Fab variants in which amino acid residue(s) in a wild-type Fab molecule is altered by substitution, addition, or deletion are also included. In a specific embodiment, mutated amino acid residue(s) comprised in Fab variants (e.g., cysteine residue(s) or lysine residue(s) after substitution, addition, or insertion) can form disulfide bond(s) with another heavy chain molecule or a portion thereof (e.g., Fab molecule).

scFab is an antigen-binding domain in which a single light chain, and a CH1 region and variable region from a single heavy chain which form Fab are linked together by a peptide linker. The light chain, and the CH1 region and variable region from the heavy chain can be retained in close proximity by the peptide linker.

"F(ab')2" or "Fab" is produced by treating an immunoglobulin (monoclonal antibody) with a protease such as pepsin and papain, and refers to an antibody fragment generated by digesting an immunoglobulin (monoclonal antibody) at near the disulfide bonds present between the hinge regions in each of the two H chains. For example, papain cleaves IgG upstream of the disulfide bonds present between the hinge regions in each of the two H chains to generate two homologous antibody fragments, in which an L chain comprising VL (L-chain variable region) and CL (L-chain constant region) is linked to an H-chain fragment comprising VH (H-chain variable region) and CHγ1 (γ1 region in an H-chain constant region) via a disulfide bond at their C-terminal regions. Each of these two homologous antibody fragments is called Fab'.

"F(ab')2" consists of two light chains and two heavy chains comprising the constant region of a CH1 domain and a portion of CH2 domains so that disulfide bonds are formed between the two heavy chains. The F(ab')2 disclosed herein can be preferably produced as follows. A whole monoclonal antibody or such comprising a desired antigen-binding domain is partially digested with a protease such as pepsin; and Fc fragments are removed by adsorption onto a Protein A column. The protease is not particularly limited, as long as it can cleave the whole antibody in a selective manner to produce F(ab')2 under an appropriate setup enzyme reaction condition such as pH. Such proteases include, for example, pepsin and ficin.

Single Domain Antibodies

Herein, those referred to by the term "single domain antibodies" are not particularly limited in their structure, as long as the domain can exert antigen-binding activity by itself. Ordinary antibodies exemplified by IgG antibodies exert antigen-binding activity in a state where a variable region is formed by the pairing of VH and VL. In contrast, a single domain antibody is known to be able to exert antigen-binding activity by its own domain structure alone without pairing with another domain. Single domain antibodies usually have a relatively low molecular weight and exist in the form of a monomer.

Examples of a single domain antibody include, but are not limited to, antigen binding molecules which naturally lack light chains, such as VHH of Camelidae animals and VNAR of sharks, and antibody fragments comprising the whole or a portion of an antibody VH domain or the whole or a portion of an antibody VL domain. Examples of a single domain antibody which is an antibody fragment comprising the whole or a portion of an antibody VH/VL domain include, but are not limited to, artificially prepared single domain antibodies originating from a human antibody VH or a human antibody VL as described, e.g., in U.S. Pat. No. 6,248,516 Bi. In some embodiments of the present invention, one single domain antibody has three CDRs (CDR1, CDR2, and CDR3).

Single domain antibodies can be obtained from animals capable of producing single domain antibodies or by immunizing animals capable of producing single domain antibodies. Examples of animals capable of producing single domain antibodies include, but are not limited to, camelids and transgenic animals into which gene(s) for the capability of producing a single domain antibody has been introduced. Camelids include camel, llama, alpaca, dromedary, guanaco, and such. Examples of a transgenic animal into which gene(s) for the capability of producing a single domain antibody has been introduced include, but are not limited to, the transgenic animals described in International Publication No. WO2015/143414 or US Patent Publication No. US2011/0123527 A1. Humanized single chain antibodies can also be obtained, by replacing framework sequences of a single domain antibody obtained from an animal with human germline sequences or sequences similar thereto. A humanized single domain antibody (e.g., humanized VHH) is one embodiment of the single domain antibody of the present invention.

Alternatively, single domain antibodies can be obtained from polypeptide libraries containing single domain antibodies by ELISA, panning, and such. Examples of polypeptide libraries containing single domain antibodies include, but are not limited to, naive antibody libraries obtained from various animals or humans (e.g., Methods in Molecular Biology 2012 911 (65-78) and Biochimica et Biophysica Acta—Proteins and Proteomics 2006 1764:8 (1307-1319)), antibody libraries obtained by immunizing various animals (e.g., Journal of Applied Microbiology 2014 117:2 (528-

536)), and synthetic antibody libraries prepared from antibody genes of various animals or humans (e.g., Journal of Biomolecular Screening 2016 21:1 (35-43), Journal of Biological Chemistry 2016 291:24 (12641-12657), and AIDS 2016 30:11 (1691-1701)).

"Binding activity" refers to the strength of the sum total of noncovalent interactions between one or more binding sites of a molecule (e.g., an antibody) and its binding partner (e.g., an antigen). Herein, binding activity is not strictly limited to a 1:1 interaction between members of a binding pair (e.g., antibody and antigen). For example, when the members of a binding pair reflect a monovalent 1:1 interaction, the binding activity refers to the intrinsic binding affinity (affinity). When a member of a binding pair is capable of both monovalent binding and multivalent binding, the binding activity is the sum of each binding strength. The binding activity of a molecule X for its partner Y can generally be represented by the dissociation constant (KD) or "amount of bound analyte per unit amount of ligand". Binding activity can be measured by common methods known in the art, including those described herein.

An "agonist" antigen-binding molecule or "agonist" antibody, as used herein, is an antigen-binding molecule or antibody which significantly potentiates a biological activity of the antigen it binds.

A "blocking" antigen-binding molecule or "blocking" antibody, or an "antagonist" antigen-binding molecule or "antagonist" antibody, as used herein, is an antigen-binding molecule or antibody which significantly inhibits (either partially or completely) a biological activity of the antigen it binds.

The phrase "substantially reduced" or "substantially different," as used herein, refers to a sufficiently high degree of difference between two numeric values (generally one associated with a molecule and the other associated with a reference/comparator molecule) such that one of skill in the art would consider the difference between the two values to be of statistical significance within the context of the biological characteristic measured by said values (e.g., KD values).

The term "substantially similar" or "substantially the same," as used herein, refers to a sufficiently high degree of similarity between two numeric values (for example, one associated with an antibody of the invention and the other associated with a reference/comparator antibody), such that one of skill in the art would consider the difference between the two values to be of little or no biological and/or statistical significance within the context of the biological characteristic measured by said values (e.g., KD values).

The terms "pharmaceutical formulation" and "pharmaceutical composition" refer to a preparation which is in such form as to permit the biological activity of an active ingredient contained therein to be effective, and which contains no additional components which are unacceptably toxic to a subject to which the formulation would be administered.

A "pharmaceutically acceptable carrier" refers to an ingredient in a pharmaceutical formulation, other than an active ingredient, which is nontoxic to a subject. A pharmaceutically acceptable carrier includes, but is not limited to, a buffer, excipient, stabilizer, or preservative.

An "individual" or "subject" is a mammal. Mammals include, but are not limited to, domesticated animals (e.g., cows, sheep, cats, dogs, and horses), primates (e.g., humans and non-human primates such as monkeys), rabbits, and rodents (e.g., mice and rats). In certain embodiments, the individual or subject is a human.

II. Antigen-Binding Molecule

In an aspect, the present disclosure is partly based on the discovery that various activities of an antigen-binding molecule that contains a first antigen-binding domain and a second antigen-binding domain in which the antigen-binding domains are linked with each other via one or more bonds, are enhanced or diminished compared to a control antigen-binding molecule containing antigen-binding domains without the linkage or linked via less bonds. In certain embodiments, an antigen-binding molecule that has activity of holding two or more antigen molecules at spatially close positions is provided. The antigen-binding molecule of the present disclosure is useful, for example, in that it can regulate the activation of two antigen molecules which are activated by association with each other. In certain other embodiments, an antigen-binding molecule that has acquired resistance to protease digestion by the linkage between the antigen-binding domains is provided.

A. Exemplary Antigen-Binding Molecules

<Structures of Antigen-Binding Molecules>

In an aspect, the present disclosure provides an antigen-binding molecule comprising a first antigen-binding domain and a second antigen-binding domain, and the antigen-binding domains are linked with each other via one or more bonds.

In an embodiment of the above aspects, at least one of the one or more bonds linking the two antigen-binding domains is a covalent bond. In certain embodiments, the covalent bond is formed by direct crosslinking of an amino acid residue in the first antigen-binding domain and an amino acid residue in the second antigen-binding domain. The crosslinked amino acid residues are, for example, cysteine, and the formed covalent bond is, for example, a disulfide bond.

In certain other embodiments, the covalent bond is formed by crosslinking of an amino acid residue in the first antigen-binding domain and an amino acid residue in the second antigen-binding domain via a crosslinking agent. The crosslinking agent is, for example, an amine-reactive crosslinking agent, and the crosslinked amino acid residues are, for example, lysine.

In an embodiment of the above aspects, at least one of the one or more bonds linking the antigen-binding domains is a noncovalent bond. In certain embodiments, the noncovalent bond is an ionic bond, hydrogen bond, or hydrophobic bond. The ionic bond is formed for example between an acidic amino acid and a basic amino acid. The acidic amino acid is for example aspartic acid (Asp) or glutamic acid (Glu). The basic amino acid is for example histidine (His), lysine (Lys), or arginine (Arg).

Amino acid residues from which the bonds between the antigen-binding domains (the bonds which link two antigen-binding domains) originate are respectively present in the first and second antigen-binding domains, and the bonds between the antigen-binding domains are formed by linking these amino acid residues. In an embodiment of the above aspects, at least one of the amino acid residues from which the bond between the antigen-binding domains originates is an artificially introduced mutated amino acid residue and, for example, it is an artificially introduced cysteine residue. Such a mutated amino acid residue can be introduced into a wild-type antigen-binding domain by, for example, a method of amino acid substitution. The present specification discloses the sites of amino acid residues from which the bond between the antigen-binding domains can originate for each of the CH1, CL, and hinge regions as constant regions and the VH, VL, and VHH regions as variable regions when the antigen-binding domains comprise for example an antibody fragment, and for example, cysteine residues can be introduced into such sites.

In an embodiment of the above aspects, at least one of the first and second antigen-binding domains has, by itself, activity of binding to an antigen (i.e., a single antigen-binding domain independently has antigen-binding activity). In certain embodiments, each of the first and second antigen-binding domains has, by itself, activity of binding to an antigen.

In an embodiment of the above aspects, the first and second antigen-binding domains are both antigen-binding domains of the same type. As stated below, examples of proteins that constitute the antigen-binding domains include polypeptides derived from an antibody or a non-antibody protein, and fragments thereof (for example, a Fab, Fab', scFab, Fv, scFv, and single domain antibody). From the viewpoint of such molecular forms, when the structures of the proteins constituting the first and second antigen-binding domains are identical, the antigen-binding domains are determined to be of the same type.

In an embodiment of the above aspects, the at least one bond which links the first antigen-binding domain and the second antigen-binding domain may be formed by linking amino acid residues present at the same position in the first antigen-binding domain and in the second antigen-binding domain with each other, or it may be formed by linking amino acid residues present at a respectively different position with each other.

Positions of amino acid residues in the antigen-binding domain can be shown according to the Kabat numbering or EU numbering system (also called the EU index) described in Kabat et al., Sequences of Proteins of Immunological Interest, 5th Ed. Public Health Service, National Institutes of Health, Bethesda, MD, 1991. For example, if the amino acid residues from which the bonds between the first and second antigen-binding domains originate are present at an identical position corresponding in the antigen-binding domains, the position of these amino acid residues can be indicated as the same number according to the Kabat numbering or EU numbering system. Alternatively, if the amino acid residues from which the bonds between the first and second antigen-binding domains originate are present at different positions which are not corresponding in the antigen-binding domains, the positions of these amino acid residues can be indicated as different numbers according to the Kabat numbering or EU numbering system.

In an embodiment of the above aspects, at least one of the first and second antigen-binding domains comprises an antibody fragment which binds to a specific antigen. In certain embodiments, the antibody fragment is a Fab, Fab', scFab, Fv, scFv, or single domain antibody. In certain embodiments, at least one of the amino acid residues from which the bonds between the antigen-binding domains originate is present in an antibody fragment.

In an embodiment of the above aspects, at least one of amino acid residues from which the bonds between the antigen-binding domains originate is present within a constant region. In certain embodiments, the amino acid residue is present within a CH1 region, and for example, it is present at any of positions 119 to 123, 131 to 140, 148 to 150, 155 to 167, 174 to 178, 188 to 197, 201 to 214, and 218 to 219 according to EU numbering in the CH1 region. In certain embodiments, the amino acid residue is present at a position selected from the group consisting of positions 119, 122, 123, 131, 132, 133, 134, 135, 136, 137, 138, 139, 140, 148, 150, 155, 156, 157, 159, 160, 161, 162, 163, 164, 165, 167, 174, 176, 177, 178, 188, 189, 190, 191, 192, 193, 194, 195, 196, 197, 201, 203, 205, 206, 207, 208, 211, 212, 213, 214, 218, and 219 according to EU numbering in the CH1 region. In certain embodiments, the amino acid residue is present at position 134, 135, 136, 137, 191, 192, 193, 194, 195, or 196 according to EU numbering in the CH1 region. In certain embodiments, the amino acid residue is present at position 135, 136, or 191 according to EU numbering in the CH1 region.

In an embodiment of the above aspects, the constant region is derived from human. In certain embodiments, the subclass of the heavy chain constant region is any of IgG1, IgG2, IgG3, IgG4, IgA1, IgA2, IgM, IgD, and IgE. In certain embodiments, the subclass of the CH1 region is any of γ1, γ2, γ3, γ4, α1, α2, s, S, and e.

In an embodiment of the above aspects, the at least one bond which links the first antigen-binding domain and the second antigen-binding domain is formed by linking an amino acid residue in the CH1 region of the first antigen-binding domain and an amino acid residue in the CH1 region of the second antigen-binding domain. In certain embodiments, the amino acid residues in the first antigen-binding domain and the second antigen-binding domain are each independently selected from the group consisting of positions 119, 120, 121, 122, and 123 according to EU numbering. In certain embodiments, the amino acid residues in the first antigen-binding domain and the second antigen-binding domain are each independently selected from the group consisting of positions 131, 132, 133, 134, 135, 136, 137, 138, 139, and 140 according to EU numbering. In certain embodiments, the amino acid residues in the first antigen-binding domain and the second antigen-binding domain are each independently selected from the group consisting of positions 148, 149, and 150 according to EU numbering. In certain embodiments, the amino acid residues in the first antigen-binding domain and the second antigen-binding domain are each independently selected from the group consisting of positions 155, 156, 157, 158, 159, 160, 161, 162, 163, 164, 165, 166, and 167 according to EU numbering. In certain embodiments, the amino acid residues in the first antigen-binding domain and the second antigen-binding domain are each independently selected from the group consisting of positions 174, 175, 176, 177, and 178 according to EU numbering. In certain embodiments, the amino acid residues in the first antigen-binding domain and the second antigen-binding domain are each independently selected from the group consisting of positions 188, 189, 190, 191, 192, 193, 194, 195, 196, and 197 according to EU numbering. In certain embodiments, the amino acid residues in the first antigen-binding domain and the second antigen-binding domain are each independently selected from the group consisting of positions 201, 202, 203, 204, 205, 206, 207, 208, 209, 210, 211, 212, 213, and 214 according to EU numbering. In certain embodiments, the amino acid residues in the first antigen-binding domain and the second antigen-binding domain are each independently selected from the group consisting of positions 218 and 219 according to EU numbering.

In an embodiment of the above aspects, the difference in the positions of the amino acid residues from which the bonds originate in each of the first antigen-binding domain and the second antigen-binding domain is three amino acids or less. This means that when the position of the amino acid residue from which a bond originates in the CH1 region of the first antigen-binding domain and the position of the amino acid residue from which the bond originates in the CH1 region of the second antigen-binding domain are respectively compared according to EU numbering, the difference is three amino acids or less. In certain embodiments, the at least one bond which links the first antigen-binding domain and the second antigen-binding domain is formed by linking the amino acid residue at position 135 according to EU numbering in the CH1 region of the first antigen-binding domain and an amino acid residue at any of positions 132 to 138 according to EU numbering in the CH1 region of the second antigen-binding domain. In certain embodiments, the at least one bond which links the first antigen-binding domain and the second antigen-binding domain is formed by linking the amino acid residue at position 136 according to EU numbering in the CH1 region of the first antigen-binding domain and an amino acid residue at any of positions 133 to 139 according to EU numbering in the CH1 region of the second antigen-binding domain.

In certain embodiments, the at least one bond which links the first antigen-binding domain and the second antigen-binding domain is formed by linking the amino acid residue at position 191 according to EU numbering in the CH1 region of the first antigen-binding domain and an amino acid residue at any of positions 188 to 194 according to EU numbering in the CH1 region of the second antigen-binding domain. In an exemplary embodiment, the at least one bond which links the first antigen-binding domain and the second antigen-binding domain is formed by linking the amino acid residues at position 135 according to EU numbering in the CH1 regions of the two antigen-binding domains with each other. In an exemplary embodiment, the at least one bond which links the first antigen-binding domain and the second antigen-binding domain is formed by linking the amino acid residues at position 136 according to EU numbering in the CH1 regions of the two antigen-binding domains with each other. In an exemplary embodiment, the at least one bond which links the first antigen-binding domain and the second antigen-binding domain is formed by linking the amino acid residues at position 191 according to EU numbering in the CH1 regions of the two antigen-binding domains with each other.

In an embodiment of the above aspects, at least one of amino acid residues from which the bonds between the antigen-binding domains originate is present within a CL region, and for example, it is present at any of positions 108 to 112, 121 to 128, 151 to 156, 184 to 190, 195 to 196, 200 to 203, and 208 to 213 according to Kabat numbering in the CL region. In certain embodiments, the amino acid residue is present at a position selected from the group consisting of positions 108, 109, 112, 121, 123, 126, 128, 151, 152, 153, 156, 184, 186, 188, 189, 190, 195, 196, 200, 201, 202, 203, 208, 210, 211, 212, and 213 according to Kabat numbering in the CL region. In certain embodiments, the amino acid residue is present at position 126 according to Kabat numbering in the CL region.

In an embodiment of the above aspects, the constant region is derived from human. In certain embodiments, the subclass of the CL region is κ or λ.

In an embodiment of the above aspects, the at least one bond which links the first antigen-binding domain and the second antigen-binding domain is formed by linking an amino acid residue in the CL region of the first antigen-binding domain and an amino acid residue in the CL region of the second antigen-binding domain. In certain embodiments, the amino acid residues in the first antigen-binding domain and the second antigen-binding domain are each independently selected from the group consisting of positions 108, 109, 110, 111, and 112 according to Kabat numbering. In certain embodiments, the amino acid residues in the first antigen-binding domain and the second antigen-binding domain are each independently selected from the group consisting of positions 121, 122, 123, 124, 125, 126, 127, and 128 according to Kabat numbering. In certain embodiments, the amino acid residues in the first antigen-binding domain and the second antigen-binding domain are each independently selected from the group consisting of positions 151, 152, 153, 154, 155, and 156 according to Kabat numbering. In certain embodiments, the amino acid residues in the first antigen-binding domain and the second antigen-binding domain are each independently selected from the group consisting of positions 184, 185, 186, 187, 188, 189, and 190 according to Kabat numbering. In certain embodiments, the amino acid residues in the first antigen-binding domain and the second antigen-binding domain are each independently selected from the group consisting of positions 195 and 196 according to Kabat numbering. In certain embodiments, the amino acid residues in the first antigen-binding domain and the second antigen-binding domain are each independently selected from the group consisting of positions 200, 201, 202, and 203 according to Kabat numbering. In certain embodiments, the amino acid residues in the first antigen-binding domain and the second antigen-binding domain are each independently selected from the group consisting of positions 208, 209, 210, 211, 212, and 213 according to Kabat numbering.

In an embodiment of the above aspects, the difference in the positions of the amino acid residues from which the bonds originate in each of the first antigen-binding domain and the second antigen-binding domain is three amino acids or less. This means that when the position of the amino acid residue from which a bond originates in the CL region of the first antigen-binding domain and the position of the amino acid residue from which the bond originates in the CL region of the second antigen-binding domain are respectively compared according to EU numbering, the difference is three amino acids or less. In an exemplary embodiment, the at least one bond which links the first antigen-binding domain and the second antigen-binding domain is formed by linking the amino acid residues at position 126 according to Kabat numbering in the CL regions of the two antigen-binding domains with each other.

In an embodiment of the above aspects, the at least one bond which links the first antigen-binding domain and the second antigen-binding domain is formed by linking an amino acid residue in the CH1 region of the first antigen-binding domain and an amino acid residue in the CL region of the second antigen-binding domain. In certain embodiments, the amino acid residues in the CH1 region of the first antigen-binding domain are selected from the group consisting of positions 188, 189, 190, 191, 192, 193, 194, 195, 196, and 197 according to EU numbering, and the amino acid residues in the CL region of the second antigen-binding domain are selected from the group consisting of positions 121, 122, 123, 124, 125, 126, 127, and 128 according to Kabat numbering. In an exemplary embodiment, the at least one bond which links the first antigen-binding domain and the second antigen-binding domain is formed by linking the amino acid residue at position 191 according to EU numbering in the CH1 region of the first antigen-binding domain and the amino acid residue at position 126 according to Kabat numbering in the CL region of the second antigen-binding domain.

In an embodiment of the above aspects, at least one of amino acid residues from which the bonds between the antigen-binding domains originate is present within a variable region. In certain embodiments, the amino acid residue is present within a VH region, and for example, it is present at a position selected from the group consisting of positions 6, 8, 16, 20, 25, 26, 28, 74, and 82b according to Kabat numbering in the VH region. In certain embodiments, the amino acid residue is present within a VL region, and for example, it is present at a position selected from the group consisting of positions 21, 27, 58, 77, 100, 105, and 107 according to Kabat numbering in the VL region (subclass K) and positions 6, 19, 33, and 34 according to Kabat numbering in the VL region (subclass X). In certain embodiments, the amino acid residue is present within a VHH region, and for example, it is present at a position selected from the group consisting of positions 4, 6, 7, 8, 9, 10, 11, 12, 14, 15, 17, 20, 24, 27, 29, 38, 39, 40, 41, 43, 44, 45, 46, 47, 48, 49, 67, 69, 71, 78, 80, 82, 82c, 85, 88, 91, 93, 94, and 107 according to Kabat numbering in the VHH region.

In an embodiment of the above aspects, at least one of the first and second antigen-binding domains comprises a non-antibody protein binding to a particular antigen, or a fragment thereof. In certain embodiments, the non-antibody protein is either of a pair of a ligand and a receptor which specifically bind to each other. Such receptors include, for example, receptors belonging to cytokine receptor superfamilies, G protein-coupled receptors, ion channel receptors, tyrosine kinase receptors, immune checkpoint receptors, antigen receptors, CD antigens, costimulatory molecules, and cell adhesion molecules.

In an embodiment of the above aspects, the first and/or second antigen-binding domains comprise a hinge region. In certain embodiments, at least one of the cysteine residues present within a wild-type hinge region is substituted to another amino acid residue. Such cysteine residues are present, for example, at positions 226 and/or 229 according to EU numbering in the wild-type hinge region. In certain embodiments, at least one of amino acid residues from which the bonds between the antigen-binding domains originate is present within a hinge region and, for example, it is present at a position selected from the group consisting of positions 216, 218, and 219 according to EU numbering in the hinge region.

In an embodiment of the above aspects, the first antigen-binding domain and the second antigen-binding domain are linked with each other via two or more bonds.

In certain embodiments, at least one of amino acid residues from which the bonds between the antigen-binding domains originate is an amino acid residue present in a wild-type sequence and, for example, it is a cysteine residue in a wild-type hinge region. In certain embodiments, the at least one bond which links the first antigen-binding domain and the second antigen-binding domain is a disulfide bond formed by crosslinking of cysteine residues present within wild-type hinge regions with each other. Such cysteine residues are present, for example, at positions 226 and/or 229 according to EU numbering of a wild-type hinge region.

In certain embodiments, at least one of amino acid residues from which the bonds between the antigen-binding domains originate is present within an antibody fragment, and at least one is present within a hinge region. In an exemplary embodiment, the antigen-binding molecule of the present disclosure is F(ab')2 in which both the first and second antigen-binding domains comprise a Fab and a hinge region.

In an embodiment of the above aspects, the antigen-binding molecule of the present disclosure further comprises an Fc region, and for example, it is a full-length antibody. In certain embodiments, one or more amino acid mutations promoting multimerization of Fc regions are introduced into the Fc region of the antigen-binding molecule of the present disclosure. Such amino acid mutations include, for example, the amino acid mutations at at least one position selected from the group consisting of positions 247, 248, 253, 254, 310, 311, 338, 345, 356, 359, 382, 385, 386, 430, 433, 434, 436, 437, 438, 439, 440, and 447 according to EU numbering (see, e.g., WO 2016/164480). In certain embodiments, the multimerization is hexamerization.

<Antigens Bound by Antigen-Binding Molecules>

In an embodiment of the above aspects, both the first and second antigen-binding domains bind to the same antigen. In certain embodiments, both the first and second antigen-binding domains bind to the same epitope on the same antigen. In certain other embodiments, each of the first and second antigen-binding domains binds to a different epitope on the same antigen. In certain embodiments, the antigen-binding molecule of the present disclosure is a biparatopic antigen-binding molecule (for example, a biparatopic antibody) that targets one specific antigen.

In another embodiment of the above aspects, each of the first and second antigen-binding domains binds to a different antigen.

In another embodiment of the above aspects, the antigen-binding molecule of the present disclosure is a clamping antigen-binding molecule (for example, a clamping antibody). A clamping antigen-binding molecule in the present specification means an antigen-binding molecule which specifically binds to an antigen/antigen-binding molecule complex formed between a given antigen A and an antigen-binding molecule which binds to antigen A, and which thereby increases the binding activity toward antigen A of the antigen-binding molecule that binds to antigen A (or alternatively, stabilizes the antigen/antigen-binding molecule complex formed by antigen A and the antigen-binding molecule that binds to antigen A). For example, a CD3 clamping antibody specifically binds to the antigen-antibody complex formed between CD3 and an antibody with reduced binding ability toward CD3 (binding-attenuated CD3 antibody) and can thereby increase the binding activity of the binding-attenuated CD3 antibody toward CD3 (or alternatively, stabilize the antigen-antibody complex formed by CD3 and the binding-attenuated CD3 antibody). In certain embodiments, the first and/or second antigen-binding domains in the antigen-binding molecule of the present disclosure can be antigen-binding domains (clamping antigen-binding domains) from clamping antigen-binding molecules.

In an embodiment of the above aspects, both the first and second antigen-binding domains have the same amino acid sequence. In another embodiment, each of the first and second antigen-binding domains has a different amino acid sequence.

In an embodiment of the above aspects, at least one of two antigens to which the first and second antigen-binding domains bind is a soluble protein or a membrane protein.

<Functions of Antigen-Binding Molecules>

In an embodiment of the above aspects, the antigen-binding molecule of the present disclosure has activity of holding two antigen molecules at spatially close positions. In certain embodiments, the antigen-binding molecule of the present disclosure is capable of holding two antigen molecules at closer positions than a control antigen-binding molecule, and the control antigen-binding molecule differs from the antigen-binding molecule of the present disclosure only in that the control antigen-binding molecule has one less bond between the two antigen-binding domains. In a further embodiment, the one less bond can be selected from bonds in which the amino acid residues from which the bonds between the antigen-binding domains originate are derived from mutated amino acid residues which are not present in a wild-type Fab or hinge region (for example, cysteine residues which are not present in the wild-type Fab or hinge region).

In another embodiment of the above aspects, the antigen-binding molecule of the present disclosure has activity of regulating interaction between two antigen molecules. Without being bound by a particular theory, the activity of regulating interaction is thought to be resulted from holding two antigen molecules at spatially closer positions by the antigen-binding molecule of the present disclosure. In certain embodiments, the antigen-binding molecule of the present disclosure is capable of enhancing or diminishing interaction between two antigen molecules as compared to a control antigen-binding molecule, and the control antigen-binding molecule differs from the antigen-binding molecule of the present disclosure only in that the control antigen-binding molecule has one less bond between the two antigen-binding domains. In a further embodiment, the one less bond can be selected from bonds in which the amino acid residues from which the bonds between the antigen-binding domains originate are derived from mutated amino acid residues which are not present in a wild-type Fab or hinge region (for example, cysteine residues which are not present in the wild-type Fab or hinge region).

In certain embodiments, the two antigen molecules bound by the antigen-binding molecule of the present disclosure are a ligand and a receptor thereof, respectively, and the antigen-binding molecule of the present disclosure has activity of promoting activation of the receptor by the ligand. In certain other embodiment, the two antigen molecules bound by the antigen-binding molecule of the present disclosure are an enzyme and a substrate thereof, respectively, and the antigen-binding molecule of the present disclosure has activity of promoting catalytic reaction of the enzyme with the substrate.

Further, in certain other embodiments, both of the two antigen molecules bound by the antigen-binding molecule of the present disclosure are antigens (for example, proteins) present on cellular surfaces, and the antigen-binding molecule of the present disclosure has activity of promoting interaction between a cell expressing the first antigen and a cell expressing the second antigen. For example, the cell expressing the first antigen and the cell expressing the second antigen are, respectively, a cell with cytotoxic activity and a target cell thereof, and the antigen-binding molecule of the present disclosure promotes damage of the target cell by the cell with cytotoxic activity. The cell with cytotoxic activity is, for example, a T cell, NK cell, monocyte, or macrophage.

In an embodiment of the above aspects, the antigen-binding molecule of the present disclosure has activity of regulating activation of two antigen molecules which are activated by association with each other. Without being bound by a particular theory, the activity of regulating activation is thought to be resulted from holding two antigen molecules at spatially closer positions by the antigen-binding molecule of the present disclosure. In certain embodiments, the antigen-binding molecule of the present disclosure can enhance or diminish activation of two antigen molecules as compared to a control antigen-binding molecule, and the control antigen-binding molecule differs from the antigen-binding molecule of the present disclosure only in that the control antigen-binding molecule has one less bond between the two antigen-binding domains. In a further embodiment, the one less bond can be selected from bonds in which the amino acid residues from which the bonds between the antigen-binding domains originate are derived from mutated amino acid residues which are not present in a wild-type Fab or hinge region (for example, cysteine residues which are not present in the wild-type Fab or hinge region). For example, such antigen molecules are selected from the group consisting of receptors belonging to cytokine receptor superfamilies, G protein-coupled receptors, ion channel receptors, tyrosine kinase receptors, immune checkpoint receptors, antigen receptors, CD antigens, costimulatory molecules, and cell adhesion molecules.

In an embodiment of the above aspects, in the antigen-binding molecule of the present disclosure, two antigen-binding domains are present at spatially close positions and/or the mobility of the two antigen-binding domains is reduced. In certain embodiments, as compared with a control antigen-binding molecule, the antigen-binding molecule of the present disclosure has two antigen-binding domains that are present at closer positions and/or the mobility of the two antigen-binding domains is more reduced, and the control antigen-binding molecule differs from the antigen-binding molecule of the present disclosure only in that it has one less bond between the two antigen-binding domains. In a further embodiment, the one less bond can be selected from bonds in which the amino acid residues from which the bonds between the antigen-binding domains originate are derived from mutated amino acid residues which are not present in a wild-type Fab or hinge region (for example, cysteine residues which are not present in the wild-type Fab or hinge region).

In an embodiment of the above aspects, the antigen-binding molecule of the present disclosure has resistance to protease cleavage. In certain embodiments, the antigen-binding molecule of the present disclosure has increased resistance to protease cleavage as compared to a control antigen-binding molecule, and the control antigen-binding molecule differs from the antigen-binding molecule of the present disclosure only in that the control antigen-binding molecule has one less bond between the two antigen-binding domains. In a further embodiment, the one less bond can be selected from bonds in which the amino acid residues from which the bonds between the antigen-binding domains originate are derived from mutated amino acid residues which are not present in a wild-type Fab or hinge region (for example, cysteine residues which are not present in the wild-type Fab or hinge region). In certain embodiments, in the antigen-binding molecule of the present disclosure, the proportion of the full-length molecule (for example, full-length IgG molecule) remaining after protease treatment is increased as compared to the control antigen-binding molecule. In certain embodiments, in the antigen-binding molecule of the present disclosure, the proportion of a particular fragment (for example, Fab monomer) produced after protease treatment is reduced as compared to the control antigen-binding molecule.

In an embodiment of the above aspects, when the antigen-binding molecule of the present disclosure is treated with a protease, a dimer of the antigen-binding domains or fragments thereof (for example, crosslinked Fab dimer) is excised. In certain embodiments, when the control antigen-binding molecule, which differs from the antigen-binding molecule of the present disclosure only in that it has one less bond between the two antigen-binding domains, is treated with the protease, monomers of the antigen-binding domains or fragments thereof are excised. In a further embodiment, the one less bond can be selected from bonds in which the amino acid residues from which the bonds between the antigen-binding domains originate are derived from mutated amino acid residues which are not present in a wild-type Fab or hinge region (for example, cysteine residues which are not present in the wild-type Fab or hinge region). In these embodiments, the protease can cleave the hinge region of the antigen-binding molecule.

In a further embodiment, the control antigen-binding molecule differs from the antigen-binding molecule of the present disclosure only in that it has one less bond between the two antigen-binding domains, and the one less bond is a bond which is formed originating from mutated amino acid residues. The mutated amino acid residues are, for example, artificially introduced cysteine residues.

<Pharmaceutical Compositions>

In an aspect, the present disclosure provides a pharmaceutical composition comprising the antigen-binding molecule of the present disclosure and a pharmaceutically acceptable carrier.

<Use of Antigen-Binding Molecules>

In an aspect, the present disclosure provides a method for holding two antigen molecules at spatially close positions, comprising:
   (a) providing an antigen-binding molecule comprising two antigen-binding domains,
   (b) adding to the antigen-binding molecule at least one bond which links the two antigen-binding domains with each other, and
   (c) contacting the antigen-binding molecule produced in (b) with the two antigen molecules.

In certain embodiments, the two antigen-binding domains in the antigen-binding molecule recited in (a) above may be linked with each other via one or more bonds, and in this case, some or all of the one or more bonds are bonds in which the amino acid residues from which the bonds between the antigen-binding domains originate are derived from amino acid residues which are present in a wild-type Fab or hinge region (for example, cysteine residues in the hinge region). In a further embodiment, said at least one bond recited in (b) above is a bond in which the amino acid residues from which the bond between the antigen-binding domains originates are derived from mutated amino acid residues which are not present in a wild-type Fab or hinge region (for example, cysteine residues which are not present in the wild-type Fab or hinge region). The present disclosure also provides a method for holding two antigen molecules at spatially close positions which comprises contacting two antigen molecules with the antigen-binding molecule or pharmaceutical composition of the present disclosure. The present disclosure further provides an antigen-binding molecule or pharmaceutical composition of the present disclosure for use in holding two antigen molecules at spatially close positions.

In another aspect, the present disclosure provides a method for regulating interaction between two antigen molecules, comprising:
   (a) providing an antigen-binding molecule comprising two antigen-binding domains,
   (b) adding to the antigen-binding molecule at least one bond which links the two antigen-binding domains with each other, and
   (c) contacting the antigen-binding molecule produced in (b) with the two antigen molecules.

In certain embodiments, the two antigen-binding domains in the antigen-binding molecule recited in (a) above may be linked with each other via one or more bonds, and in this case, some or all of the one or more bonds are bonds in which the amino acid residues from which the bonds between the antigen-binding domains originate are derived from amino acid residues which are present in a wild-type Fab or hinge region (for example, cysteine residues in the hinge region). In a further embodiment, said at least one bond recited in (b) above is a bond in which the amino acid residues from which the bond between the antigen-binding domains originates are derived from mutated amino acid residues which are not present in a wild-type Fab or hinge region (for example, cysteine residues which are not present in the wild-type Fab or hinge region). The present disclosure also provides a method for regulating interaction between two antigen molecules which comprises contacting two antigen molecules with the antigen-binding molecule or pharmaceutical composition of the present disclosure. The present disclosure further provides an antigen-binding molecule or pharmaceutical composition of the present disclosure for use in regulating interaction between two antigen molecules.

Further, in another aspect, the present disclosure provides a method for regulating activity of two antigen molecules which are activated by association with each other, comprising:
   (a) providing an antigen-binding molecule comprising two antigen-binding domains,
   (b) adding to the antigen-binding molecule at least one bond which links the two antigen-binding domains with each other, and
   (c) contacting the antigen-binding molecule produced in (b) with the two antigen molecules.

In certain embodiments, the two antigen-binding domains in the antigen-binding molecule recited in (a) above may be linked with each other via one or more bonds, and in this case, some or all of the one or more bonds are bonds in which the amino acid residues from which the bonds between the antigen-binding domains originate are derived from amino acid residues which are present in a wild-type Fab or hinge region (for example, cysteine residues in the hinge region). In a further embodiment, said at least one bond recited in (b) above is a bond in which the amino acid residues from which the bond between the antigen-binding domains originates are derived from mutated amino acid residues which are not present in a wild-type Fab or hinge region (for example, cysteine residues which are not present in the wild-type Fab or hinge region). The present disclosure also provides a method for regulating activity of two antigen molecules which are activated by association with each other, which comprises contacting two antigen molecules with the antigen-binding molecule or pharmaceutical composition of the present disclosure. The present disclosure further provides an antigen-binding molecule or pharmaceutical composition of the present disclosure for use in regulating activity of two antigen molecules which are activated by association with each other.

Further, in another aspect, the present disclosure provides a method for placing two antigen-binding domains at spatially close positions and/or reducing the mobility of two antigen-binding domains, comprising:
   (a) providing an antigen-binding molecule comprising two antigen-binding domains, and
   (b) adding to the antigen-binding molecule at least one bond which links the two antigen-binding domains with each other.

In certain embodiments, the two antigen-binding domains in the antigen-binding molecule recited in (a) above may be linked with each other via one or more bonds, and in this case, some or all of the one or more bonds are bonds in which the amino acid residues from which the bonds between the antigen-binding domains originate are derived from amino acid residues which are present in a wild-type Fab or hinge region (for example, cysteine residues in the hinge region). In a further embodiment, said at least one bond recited in (b) above is a bond in which the amino acid residues from which the bond between the antigen-binding domains originates are derived from mutated amino acid residues which are not present in a wild-type Fab or hinge region (for example, cysteine residues which are not present in the wild-type Fab or hinge region).

Furthermore, in another aspect, the present disclosure provides a method for increasing resistance of an antigen-binding molecule to protease cleavage, comprising:
(a) providing an antigen-binding molecule comprising two antigen-binding domains, and
(b) adding to the antigen-binding molecule at least one bond which links the two antigen-binding domains with each other.

In certain embodiments, the two antigen-binding domains in the antigen-binding molecule recited in (a) above may be linked with each other via one or more bonds, and in this case, some or all of the one or more bonds are bonds in which the amino acid residues from which the bonds between the antigen-binding domains originate are derived from amino acid residues which are present in a wild-type Fab or hinge region (for example, cysteine residues in the hinge region). In a further embodiment, said at least one bond recited in (b) above is a bond in which the amino acid residues from which the bond between the antigen-binding domains originates are derived from mutated amino acid residues which are not present in a wild-type Fab or hinge region (for example, cysteine residues which are not present in the wild-type Fab or hinge region).

The antigen-binding molecule used in these various methods may have the characteristics of the antigen-binding molecules described herein.

<Methods for Producing Antigen-Binding Molecules>

In an aspect, the present disclosure provides a method for producing an antigen-binding molecule which has activity of holding two antigen molecules at spatially close positions, comprising:
(a) providing a nucleic acid encoding a polypeptide comprising a first antigen-binding domain and a nucleic acid encoding a polypeptide comprising a second antigen-binding domain,
(b) introducing a mutation into the nucleic acids encoding the two antigen-binding domains such that at least one bond linking the two antigen-binding domains is added,
(c) introducing the nucleic acids produced in (b) into a host cell,
(d) culturing the host cell such that the two polypeptides are expressed, and
(e) obtaining an antigen-binding molecule which is a polypeptide comprising the first and second antigen-binding domains, wherein the two antigen-binding domains are linked with each other via one or more bonds.

In certain embodiments, each of the two antigen-binding domains recited in (a) above may comprise one or more amino acid residues from which the bonds for linking the two antigen-binding domains originate, and in this case, some or all of the one or more amino acid residues from which the bond between the antigen-binding domains originates are amino acid residues which are present in a wild-type Fab or hinge region (for example, cysteine residues in the hinge region). In a further embodiment, said at least one bond recited in (b) above is a bond in which the amino acid residues from which the bond between the antigen-binding domains originates are derived from mutated amino acid residues which are not present in a wild-type Fab or hinge region (for example, cysteine residues which are not present in the wild-type Fab or hinge region).

In another aspect, the present disclosure provides a method for producing an antigen-binding molecule which has activity of regulating interaction between two antigen molecules, comprising:
(a) providing a nucleic acid encoding a polypeptide comprising a first antigen-binding domain and a nucleic acid encoding a polypeptide comprising a second antigen-binding domain,
(b) introducing a mutation into the nucleic acids encoding the two antigen-binding domains such that at least one bond linking the two antigen-binding domains is added,
(c) introducing the nucleic acids produced in (b) into a host cell,
(d) culturing the host cell such that the two polypeptides are expressed, and
(e) obtaining an antigen-binding molecule which is a polypeptide comprising the first and second antigen-binding domains, wherein the two antigen-binding domains are linked with each other via one or more bonds.

In certain embodiments, each of the two antigen-binding domains recited in (a) above may comprise one or more amino acid residues from which the bonds for linking the two antigen-binding domains originate, and in this case, some or all of the one or more amino acid residues from which the bond between the antigen-binding domains originates are amino acid residues which are present in a wild-type Fab or hinge region (for example, cysteine residues in the hinge region). In a further embodiment, said at least one bond recited in (b) above is a bond in which the amino acid residues from which the bond between the antigen-binding domains originates are derived from mutated amino acid residues which are not present in a wild-type Fab or hinge region (for example, cysteine residues which are not present in the wild-type Fab or hinge region).

Further, in another aspect, the present disclosure provides a method for producing an antigen-binding molecule which has activity of regulating activation of two antigen molecules which are activated by association with each other, comprising:
(a) providing a nucleic acid encoding a polypeptide comprising a first antigen-binding domain and a nucleic acid encoding a polypeptide comprising a second antigen-binding domain,
(b) introducing a mutation into the nucleic acids encoding the two antigen-binding domains such that at least one bond linking the two antigen-binding domains is added,
(c) introducing the nucleic acids produced in (b) into a host cell,
(d) culturing the host cell such that the two polypeptides are expressed, and
(e) obtaining an antigen-binding molecule which is a polypeptide comprising the first and second antigen-binding domains, wherein the two antigen-binding domains are linked with each other via one or more bonds.

In certain embodiments, each of the two antigen-binding domains recited in (a) above may comprise one or more amino acid residues from which the bonds for linking the two antigen-binding domains originate, and in this case, some or all of the one or more amino acid residues from which the bond between the antigen-binding domains originates are amino acid residues which are present in a wild-type Fab or hinge region (for example, cysteine residues in the hinge region). In a further embodiment, said at least one bond recited in (b) above is a bond in which the amino acid residues from which the bond between the antigen-binding domains originates are derived from mutated amino acid residues which are not present in a wild-type Fab or hinge region (for example, cysteine residues which are not present in the wild-type Fab or hinge region).

Further, in another aspect, the present disclosure provides a method for producing an antigen-binding molecule in which two antigen-binding domains are present at spatially close positions and/or the mobility of two antigen-binding domains is reduced, comprising:
  (a) providing a nucleic acid encoding a polypeptide comprising a first antigen-binding domain and a nucleic acid encoding a polypeptide comprising a second antigen-binding domain,
  (b) introducing a mutation into the nucleic acids encoding the two antigen-binding domains such that at least one bond linking the two antigen-binding domains is added,
  (c) introducing the nucleic acids produced in (b) into a host cell,
  (d) culturing the host cell such that the two polypeptides are expressed, and
  (e) obtaining an antigen-binding molecule which is a polypeptide comprising the first and second antigen-binding domains, wherein the two antigen-binding domains are linked with each other via one or more bonds.

In certain embodiments, each of the two antigen-binding domains recited in (a) above may comprise one or more amino acid residues from which the bonds for linking the two antigen-binding domains originate, and in this case, some or all of the one or more amino acid residues from which the bond between the antigen-binding domains originates are amino acid residues which are present in a wild-type Fab or hinge region (for example, cysteine residues in the hinge region). In a further embodiment, said at least one bond recited in (b) above is a bond in which the amino acid residues from which the bond between the antigen-binding domains originates are derived from mutated amino acid residues which are not present in a wild-type Fab or hinge region (for example, cysteine residues which are not present in the wild-type Fab or hinge region).

Furthermore, in another aspect, the present disclosure provides a method for producing an antigen-binding molecule which has increased resistance to protease cleavage, comprising:
  (a) providing a nucleic acid encoding a polypeptide comprising a first antigen-binding domain and a nucleic acid encoding a polypeptide comprising a second antigen-binding domain,
  (b) introducing a mutation into the nucleic acids encoding the two antigen-binding domains such that at least one bond linking the two antigen-binding domains is added,
  (c) introducing the nucleic acids produced in (b) into a host cell,
  (d) culturing the host cell such that the two polypeptides are expressed, and
  (e) obtaining an antigen-binding molecule which is a polypeptide comprising the first and second antigen-binding domains, wherein the two antigen-binding domains are linked with each other via one or more bonds.

In certain embodiments, each of the two antigen-binding domains recited in (a) above may comprise one or more amino acid residues from which the bonds for linking the two antigen-binding domains originate, and in this case, some or all of the one or more amino acid residues from which the bond between the antigen-binding domains originates are amino acid residues which are present in a wild-type Fab or hinge region (for example, cysteine residues in the hinge region). In a further embodiment, said at least one bond recited in (b) above is a bond in which the amino acid residues from which the bond between the antigen-binding domains originates are derived from mutated amino acid residues which are not present in a wild-type Fab or hinge region (for example, cysteine residues which are not present in the wild-type Fab or hinge region).

The antigen-binding molecule produced in these various aspects may have the characteristics of the antigen-binding molecules described herein.

<Methods of Screening for Antigen-Binding Molecules>

In another aspect, the present disclosure provides a method for identifying a novel pair of protein molecules which are activated by association with each other, comprising:
  (a) providing two arbitrary protein molecules,
  (b) producing, by the production method of the present disclosure, an antigen-binding molecule comprising two antigen-binding domains which respectively bind to the two protein molecules,
  (c) contacting the antigen-binding molecule produced in (b) with the two protein molecules, and
  (d) assessing whether or not the two protein molecules are activated.

In certain embodiments, at least one of the two protein molecules is selected from the group consisting of receptors belonging to cytokine receptor superfamilies, G protein-coupled receptors, ion channel receptors, tyrosine kinase receptors, immune checkpoint receptors, antigen receptors, CD antigens, costimulatory molecules, and cell adhesion molecules.

A. Exemplary Antigen-Binding Molecules

<Structures of Antigen-Binding Molecules>

In an aspect, the present disclosure provides an antigen-binding molecule comprising a first antigen-binding domain and a second antigen-binding domain, and the antigen-binding domains are linked with each other via two or more bonds. In an embodiment, at least one of the first and second antigen-binding domains has, by itself, activity of binding to an antigen (i.e., a single antigen-binding domain independently has antigen-binding activity). In certain embodiments, each of the first and second antigen-binding domains has, by itself, activity of binding to an antigen.

In an embodiment of the above aspects, at least one of the first and second antigen-binding domains comprises an antibody fragment which binds to a particular antigen. In certain embodiments, the first and/or second antigen-binding domains comprise a hinge region. Amino acid residues from which the bonds between the antigen-binding domains originate are respectively present in the first and second antigen-binding domains, and the bonds between the antigen-binding domains are formed by linking these amino acid residues. In certain embodiments, at least one of amino acid residues from which the bonds between the antigen-binding domains originate is present within the antibody fragment. In certain embodiments, at least one of amino acid residues from which the bonds between the antigen-binding domains originate is present within a hinge region. In certain embodiments, at least one of amino acid residues from which the bonds between the antigen-binding domains originate is present within the antibody fragment, and at least one of the amino acid residues is present within a hinge region.

In an embodiment of the above aspects, in at least one of the first and second antigen-binding domains, multiple amino acid residues from which the bonds between the antigen-binding domains originate are present at positions at a distance of seven amino acids or more from each other in the primary structure. This means that, between any two amino acid residues of the above multiple amino acid residues, six or more amino acid residues which are not said amino acid residues are present. In certain embodiments, combinations of multiple amino acid residues from which the bonds between the antigen-binding domains originate include a pair of amino acid residues which are present at positions at a distance of less than seven amino acids in the primary structure. In certain embodiments, if the first and second antigen-binding domains are linked each other via three or more bonds, the bonds between the antigen-binding domains may originate from three or more amino acid residues including a pair of amino acid residues which are present at positions at a distance of seven amino acids or more in the primary structure.

In certain embodiments, amino acid residues present at the same position in the first antigen-binding domain and in the second antigen-binding domain are linked with each other to form a bond. In certain embodiments, amino acid residues present at a different position in the first antigen-binding domain and in the second antigen-binding domain are linked with each other to form a bond.

Positions of amino acid residues in the antigen-binding domain can be shown according to the Kabat numbering or EU numbering system (also called the EU index) described in Kabat et al., Sequences of Proteins of Immunological Interest, 5th Ed. Public Health Service, National Institutes of Health, Bethesda, MD, 1991. For example, if the amino acid residues from which the bonds between the first and second antigen-binding domains originate are present at an identical position corresponding in the antigen-binding domains, the position of these amino acid residues can be indicated as the same number according to the Kabat numbering or EU numbering system. Alternatively, if the amino acid residues from which the bonds between the first and second antigen-binding domains originate are present at different positions which are not corresponding in the antigen-binding domains, the positions of these amino acid residues can be indicated as different numbers according to the Kabat numbering or EU numbering system.

In an embodiment of the above aspects, at least one of the two or more bonds linking the antigen-binding domains is a covalent bond. In certain embodiments, the covalent bond is formed by direct crosslinking of an amino acid residue in the first antigen-binding domain and an amino acid residue in the second antigen-binding domain. The crosslinked amino acid residues are, for example, cysteine, and the formed covalent bond is, for example, a disulfide bond. At least one of the crosslinked cysteine residues may be present within a hinge region.

In certain other embodiments, the covalent bond is formed by crosslinking of an amino acid residue in the first antigen-binding domain and an amino acid residue in the second antigen-binding domain via a crosslinking agent. The crosslinking agent is, for example, an amine-reactive crosslinking agent, and the crosslinked amino acid residues are, for example, lysine.

In an embodiment of the above aspects, at least one of the two or more bonds linking the antigen-binding domains is a noncovalent bond. In certain embodiments, the noncovalent bond is an ionic bond, hydrogen bond, or hydrophobic bond.

In an embodiment of the above aspects, the antibody fragment is a Fab, Fab', scFab, Fv, scFv, or single domain antibody.

In an embodiment of the above aspects, at least one of amino acid residues from which the bonds between the antigen-binding domains originate is present within a constant region.

In certain embodiments, the amino acid residue is present within a CH1 region, and for example, it is present at a position selected from the group consisting of positions 119, 122, 123, 131, 132, 133, 134, 135, 136, 137, 139, 140, 148, 150, 155, 156, 157, 159, 160, 161, 162, 163, 165, 167, 174, 176, 177, 178, 190, 191, 192, 194, 195, 197, 213, and 214 according to EU numbering in the CH1 region. In an exemplary embodiment, the amino acid residue is present at position 191 according to EU numbering in the CH1 region, and the amino acid residues at position 191 according to EU numbering in the CH1 region of the two antigen-binding domains are linked with each other to form a bond.

In certain embodiments, at least one of amino acid residues from which the bonds between the antigen-binding domains originate is present within a hinge region, and for example, it is present at a position selected from the group consisting of positions 216, 218, and 219 according to EU numbering in the hinge region.

In certain embodiments, at least one of amino acid residues from which the bonds between the antigen-binding domains originate is present within a CL region, and for example, it is present at a position selected from the group consisting of positions 109, 112, 121, 126, 128, 151, 152, 153, 156, 184, 186, 188, 190, 200, 201, 202, 203, 208, 210, 211, 212, and 213 according to EU numbering in the CL region. In an exemplary embodiment, the amino acid residue is present at position 126 according to EU numbering in the CL region, and the amino acid residues at position 126 according to EU numbering in the CL region of the two antigen-binding domains are linked with each other to form a bond.

In certain embodiments, an amino acid residue in the CH1 region of the first antigen-binding domain and an amino acid residue in the CL region of the second antigen-binding domain are linked to form a bond. In an exemplary embodiment, an amino acid residue at position 191 according to EU numbering in the CH1 region of the first antigen-binding domain and an amino acid residue at position 126 according to EU numbering in the CL region of the second antigen-binding domain are linked to form a bond.

In an embodiment of the above aspects, the constant region is derived from human. In certain embodiments, the subclass of the heavy chain constant region is any of IgG1, IgG2, IgG3, IgG4, IgA1, IgA2, IgM, IgD, and IgE. In certain embodiments, the subclass of the CH1 region is any of γ1, γ2, 73, γ4, α1, α2, p, S, and E. In certain embodiments, the subclass of the CL region is a or X.

In an embodiment of the above aspects, at least one of amino acid residues from which the bonds between the antigen-binding domains originate is present within a variable region. In certain embodiments, the amino acid residue is present within a VH region, and for example, it is present at a position selected from the group consisting of positions 8, 16, 28, 74, and 82b according to Kabat numbering in the VH region. In certain embodiments, the amino acid residue is present within a VL region, and for example, it is present at a position selected from the group consisting of positions 100, 105, and 107 according to Kabat numbering in the VL region.

In an embodiment of the above aspects, both the first and second antigen-binding domains comprise a Fab and a hinge region.

In certain embodiments, at least one of amino acid residues from which the bonds between the antigen-binding domains originate is an amino acid residue present in a wild-type Fab or hinge region, and for example, it is a cysteine residue in the hinge region. Examples of such cysteine residues include the cysteine residues at positions 226 and 229 according to EU numbering.

In certain other embodiments, at least one of amino acid residues from which the bonds between the antigen-binding domains originate is a mutated amino acid residue which is not present in a wild-type Fab or hinge region, and for example, it is a cysteine residue which is not present in a wild-type Fab or hinge region. Such a mutated amino acid residue can be introduced into a wild-type Fab or hinge region by, for example, a method of amino acid substitution. The present specification discloses the sites of amino acid residues from which the bonds between the antigen-binding domains can originate for each of the CH1, hinge, CL, VH, and VL regions, and for example, cysteine residues can be introduced into such sites.

Alternatively, in another embodiment, an amino acid residue that is present in a wild-type Fab or hinge region and which is involved in a bond between the antigen-binding domains (for example, a cysteine residue) can be substituted with another amino acid or deleted. Examples of such cysteine residues include the cysteine residues at positions 220, 226, and 229 according to EU numbering in the hinge region, and the cysteine residue at position 214 in the CL region.

In certain embodiments, the antigen-binding molecule of the present disclosure is F(ab')2 in which both the first and second antigen-binding domains comprise a Fab and a hinge region.

In an embodiment of the above aspects, at least one of the first and second antigen-binding domains comprises a non-antibody protein binding to a particular antigen, or a fragment thereof. In certain embodiments, the non-antibody protein is either of a pair of a ligand and a receptor which specifically bind to each other. Such receptors include, for example, receptors belonging to cytokine receptor super-families, G protein-coupled receptors, ion channel receptors, tyrosine kinase receptors, immune checkpoint receptors, antigen receptors, CD antigens, costimulatory molecules, and cell adhesion molecules.

In an embodiment of the above aspects, the antigen-binding molecule of the present disclosure further comprises an Fc region, and for example, it is a full-length antibody. In certain embodiments, one or more amino acid mutations promoting multimerization of Fc regions are introduced into the Fc region of the antigen-binding molecule of the present disclosure. Such amino acid mutations include, for example, the amino acid mutations at at least one position selected from the group consisting of positions 247, 248, 253, 254, 310, 311, 338, 345, 356, 359, 382, 385, 386, 430, 433, 434, 436, 437, 438, 439, 440, and 447 according to EU numbering (see, e.g., WO 2016/164480). In certain embodiments, the multimerization is hexamerization.

<Antigens Bound by Antigen-Binding Molecules>

In an embodiment of the above aspects, both the first and second antigen-binding domains bind to the same antigen. In certain embodiments, both the first and second antigen-binding domains bind to the same epitope on the same antigen. In certain other embodiments, each of the first and second antigen-binding domains binds to a different epitope on the same antigen. In certain embodiments, the antigen-binding molecule of the present disclosure is a biparatopic antigen-binding molecule (for example, biparatopic antibody) that targets one specific antigen.

In an embodiment of the above aspects, each of the first and second antigen-binding domains binds to a different antigen.

In another embodiment of the above aspects, the antigen-binding molecule of the present disclosure is a clamping antigen-binding molecule (for example, clamping antibody). Herein, a clamping antigen-binding molecule refers to an antigen-binding molecule that specifically binds to an antigen/antigen-binding molecule complex formed by a certain antigen A and an antigen-binding molecule binding to the antigen A, and thereby increases the activity of the antigen-binding molecule binding to the antigen A to bind the antigen A (or stabilize the antigen/antigen-binding molecule complex formed by the antigen A and the antigen-binding molecule binding to the antigen A). For example, a CD3 clamping antibody is able to bind to an antigen-antibody complex formed by CD3 and an antibody with attenuated binding ability to CD3 (binding-attenuated CD3 antibody), and thereby increase the CD3-binding activity of the binding-attenuated CD3 antibody (or stabilize the antigen-antibody complex formed by CD3 and the binding-attenuated CD3 antibody). In certain embodiments, the first and/or second antigen-binding domains in the antigen-binding molecule of the present disclosure may be antigen-binding domains derived from clamping antigen-binding molecules (clamping antigen-binding domains).

In an embodiment of the above aspects, both the first and second antigen-binding domains have the same amino acid sequence. In another embodiment, each of the first and second antigen-binding domains has a different amino acid sequence.

In an embodiment of the above aspects, at least one of two antigens to which the first and second antigen-binding domains bind is a soluble protein or a membrane protein.

<Functions of Antigen-Binding Molecules>

In an embodiment of the above aspects, the antigen-binding molecule of the present disclosure has activity of holding two antigen molecules at spatially close positions. In certain embodiments, the antigen-binding molecule of the present disclosure is capable of holding two antigen molecules at closer positions than a control antigen-binding molecule, and the control antigen-binding molecule differs from the antigen-binding molecule of the present disclosure only in that the control antigen-binding molecule has one less bond between the two antigen-binding domains. In a further embodiment, the one less bond can be selected from bonds in which the amino acid residues from which the bonds between the antigen-binding domains originate are derived from mutated amino acid residues which are not present in a wild-type Fab or hinge region (for example, cysteine residues which are not present in the wild-type Fab or hinge region).

In an embodiment of the above aspects, the antigen-binding molecule of the present disclosure has activity of regulating interaction between two antigen molecules. Without being bound by a particular theory, the activity of regulating interaction is thought to be resulted from holding two antigen molecules at spatially closer positions by the antigen-binding molecule of the present disclosure. In certain embodiments, the antigen-binding molecule of the present disclosure is capable of enhancing or diminishing interaction between two antigen molecules as compared to a control antigen-binding molecule, and the control antigen-binding molecule differs from the antigen-binding molecule of the present disclosure only in that the control antigen-binding molecule has one less bond between the two antigen-binding domains. In a further embodiment, the one less bond can be selected from bonds in which the amino acid residues from which the bonds between the antigen-binding domains originate are derived from mutated amino acid residues which are not present in a wild-type Fab or hinge region (for example, cysteine residues which are not present in the wild-type Fab or hinge region).

In certain embodiments, the two antigen molecules bound by the antigen-binding molecule of the present disclosure are a ligand and a receptor thereof, respectively, and the antigen-binding molecule of the present disclosure has activity of promoting activation of the receptor by the ligand. In certain other embodiment, the two antigen molecules bound by the antigen-binding molecule of the present disclosure are an enzyme and a substrate thereof, respectively, and the antigen-binding molecule of the present disclosure has activity of promoting catalytic reaction of the enzyme with the substrate.

Further, in certain other embodiments, both of the two antigen molecules bound by the antigen-binding molecule of the present disclosure are antigens (for example, proteins) present on cellular surfaces, and the antigen-binding molecule of the present disclosure has activity of promoting interaction between a cell expressing the first antigen and a cell expressing the second antigen. For example, the cell expressing the first antigen and the cell expressing the second antigen are, respectively, a cell with cytotoxic activity and a target cell thereof, and the antigen-binding molecule of the present disclosure promotes damage of the target cell by the cell with cytotoxic activity. The cell with cytotoxic activity is, for example, a T cell, NK cell, monocyte, or macrophage.

In an embodiment of the above aspects, the antigen-binding molecule of the present disclosure has activity of regulating activation of two antigen molecules which are activated by association with each other. Without being bound by a particular theory, the activity of regulating activation is thought to be resulted from holding two antigen molecules at spatially closer positions by the antigen-binding molecule of the present disclosure. In certain embodiments, the antigen-binding molecule of the present disclosure can enhance or diminish activation of two antigen molecules as compared to a control antigen-binding molecule, and the control antigen-binding molecule differs from the antigen-binding molecule of the present disclosure only in that the control antigen-binding molecule has one less bond between the two antigen-binding domains. In a further embodiment, the one less bond can be selected from bonds in which the amino acid residues from which the bonds between the antigen-binding domains originate are derived from mutated amino acid residues which are not present in a wild-type Fab or hinge region (for example, cysteine residues which are not present in the wild-type Fab or hinge region). For example, such antigen molecules are selected from the group consisting of receptors belonging to cytokine receptor superfamilies, G protein-coupled receptors, ion channel receptors, tyrosine kinase receptors, immune checkpoint receptors, antigen receptors, CD antigens, costimulatory molecules, and cell adhesion molecules.

In an embodiment of the above aspects, the antigen-binding molecule of the present disclosure has resistance to protease cleavage. In certain embodiments, the antigen-binding molecule of the present disclosure has increased resistance to protease cleavage as compared to a control antigen-binding molecule, and the control antigen-binding molecule differs from the antigen-binding molecule of the present disclosure only in that the control antigen-binding molecule has one less bond between the two antigen-binding domains. In a further embodiment, the one less bond can be selected from bonds in which the amino acid residues from which the bonds between the antigen-binding domains originate are derived from mutated amino acid residues which are not present in a wild-type Fab or hinge region (for example, cysteine residues which are not present in the wild-type Fab or hinge region). In certain embodiments, in the antigen-binding molecule of the present disclosure, the proportion of the full-length molecule (for example, full-length IgG molecule) remaining after protease treatment is increased as compared to the control antigen-binding molecule. In certain embodiments, in the antigen-binding molecule of the present disclosure, the proportion of a particular fragment (for example, Fab monomer) produced after protease treatment is reduced as compared to the control antigen-binding molecule.

In an embodiment of the above aspects, when the antigen-binding molecule of the present disclosure is treated with a protease, a dimer of the antigen-binding domains or fragments thereof (for example, crosslinked Fab dimer) is excised. In certain embodiments, when the control antigen-binding molecule, which differs from the antigen-binding molecule of the present disclosure only in that it has one less bond between the two antigen-binding domains, is treated with the protease, monomers of the antigen-binding domains or fragments thereof are excised. In a further embodiment, the one less bond can be selected from bonds in which the amino acid residues from which the bonds between the antigen-binding domains originate are derived from mutated amino acid residues which are not present in a wild-type Fab or hinge region (for example, cysteine residues which are not present in the wild-type Fab or hinge region). In these embodiments, the protease can cleave the hinge region of the antigen-binding molecule.

<Pharmaceutical Compositions>

In an aspect, the present disclosure provides a pharmaceutical composition comprising the antigen-binding molecule of the present disclosure and a pharmaceutically acceptable carrier.

<Use of Antigen-Binding Molecules>

In an aspect, the present disclosure provides a method for holding two antigen molecules at spatially close positions, comprising:
  (a) providing an antigen-binding molecule comprising two antigen-binding domains, wherein the two antigen-binding domains are linked with each other via one or more bonds,
  (b) adding to the antigen-binding molecule another bond which links the two antigen-binding domains with each other, and
  (c) contacting the antigen-binding molecule produced in (b) with the two antigen-binding molecules.

In certain embodiments, some or all of the one or more bonds recited in (a) above are bonds in which the amino acid residues from which the bonds between the antigen-binding domains originate are derived from amino acid residues which are present in a wild-type Fab or hinge region (for example, cysteine residues in the hinge region). In a further embodiment, said another bond recited in (b) above is a bond in which the amino acid residues from which the bond between the antigen-binding domains originates are derived from mutated amino acid residues which are not present in a wild-type Fab or hinge region (for example, cysteine residues which are not present in the wild-type Fab or hinge region). The present disclosure also provides a method for holding two antigen molecules at spatially close positions which comprises contacting two antigen molecules with the antigen-binding molecule or pharmaceutical composition of the present disclosure. The present disclosure further provides an antigen-binding molecule or pharmaceutical composition of the present disclosure for use in holding two antigen molecules at spatially close positions.

In another aspect, the present disclosure provides a method for regulating interaction between two antigen molecules, comprising:
(a) providing an antigen-binding molecule comprising two antigen-binding domains, wherein the two antigen-binding domains are linked with each other via one or more bonds,
(b) adding to the antigen-binding molecule another bond which links the two antigen-binding domains with each other, and
(c) contacting the antigen-binding molecule produced in (b) with the two antigen-binding molecules.

In certain embodiments, some or all of the one or more bonds recited in (a) above are bonds in which the amino acid residues from which the bonds between the antigen-binding domains originate are derived from amino acid residues which are present in a wild-type Fab or hinge region (for example, cysteine residues in the hinge region). In a further embodiment, said another bond recited in (b) above is a bond in which the amino acid residues from which the bond between the antigen-binding domains originates are derived from mutated amino acid residues which are not present in a wild-type Fab or hinge region (for example, cysteine residues which are not present in the wild-type Fab or hinge region). The present disclosure also provides a method for regulating interaction between two antigen molecules which comprises contacting two antigen molecules with the antigen-binding molecule or pharmaceutical composition of the present disclosure. The present disclosure further provides an antigen-binding molecule or pharmaceutical composition of the present disclosure for use in regulating interaction between two antigen molecules.

Further, in another aspect, the present disclosure provides a method for regulating activity of two antigen molecules which are activated by association with each other, comprising:
(a) providing an antigen-binding molecule comprising two antigen-binding domains, wherein the two antigen-binding domains are linked with each other via one or more bonds,
(b) adding to the antigen-binding molecule another bond which links the two antigen-binding domains with each other, and
(c) contacting the antigen-binding molecule produced in (b) with the two antigen-binding molecules.

In certain embodiments, some or all of the one or more bonds recited in (a) above are bonds in which the amino acid residues from which the bonds between the antigen-binding domains originate are derived from amino acid residues which are present in a wild-type Fab or hinge region (for example, cysteine residues in the hinge region). In a further embodiment, said another bond recited in (b) above is a bond in which the amino acid residues from which the bond between the antigen-binding domains originates are derived from mutated amino acid residues which are not present in a wild-type Fab or hinge region (for example, cysteine residues which are not present in the wild-type Fab or hinge region). The present disclosure also provides a method for regulating activity of two antigen molecules which are activated by association with each other, which comprises contacting two antigen molecules with the antigen-binding molecule or pharmaceutical composition of the present disclosure. The present disclosure further provides an antigen-binding molecule or pharmaceutical composition of the present disclosure for use in regulating activity of two antigen molecules which are activated by association with each other.

Furthermore, in another aspect, the present disclosure provides a method for increasing resistance of an antigen-binding molecule to protease cleavage, comprising:
(a) providing an antigen-binding molecule comprising two antigen-binding domains, wherein the two antigen-binding domains are linked with each other via one or more bonds, and
(b) adding to the antigen-binding molecule another bond which links the two antigen-binding domains with each other.

In certain embodiments, some or all of the one or more bonds recited in (a) above are bonds in which the amino acid residues from which the bonds between the antigen-binding domains originate are derived from amino acid residues which are present in a wild-type Fab or hinge region (for example, cysteine residues in the hinge region). In a further embodiment, said another bond recited in (b) above is a bond in which the amino acid residues from which the bond between the antigen-binding domains originates are derived from mutated amino acid residues which are not present in a wild-type Fab or hinge region (for example, cysteine residues which are not present in the wild-type Fab or hinge region).

The antigen-binding molecule used in these various methods may have the characteristics of the antigen-binding molecules described herein.

<Methods for Producing Antigen-Binding Molecules>

In an aspect, the present disclosure provides a method for producing an antigen-binding molecule which has activity of holding two antigen molecules at spatially close positions, comprising:
(a) providing a nucleic acid encoding a polypeptide comprising a first antigen-binding domain and a nucleic acid encoding a polypeptide comprising a second antigen-binding domain, wherein each of the two antigen-binding domains comprises one or more amino acid residues from which a bond for linking the two antigen-binding domains originates,
(b) introducing a mutation into the nucleic acids encoding the two antigen-binding domains such that another bond linking the two antigen-binding domains is added,
(c) introducing the nucleic acids produced in (b) into a host cell,
(d) culturing the host cell such that the two polypeptides are expressed, and
(e) obtaining an antigen-binding molecule which is a polypeptide comprising the first and second antigen-binding domains, wherein the two antigen-binding domains are linked with each other via two or more bonds.

In certain embodiments, some or all of the one or more amino acid residues recited in (a) above from which the bond between the antigen-binding domains originates are amino acid residues which are present in a wild-type Fab or hinge region (for example, cysteine residues in the hinge region). In a further embodiment, said another bond recited in (b) above is a bond in which the amino acid residues from which the bond between the antigen-binding domains originates are derived from mutated amino acid residues which are not present in a wild-type Fab or hinge region (for example, cysteine residues which are not present in the wild-type Fab or hinge region).

In another aspect, the present disclosure provides a method for producing an antigen-binding molecule which has activity of regulating interaction between two antigen molecules, comprising:
(a) providing a nucleic acid encoding a polypeptide comprising a first antigen-binding domain and a nucleic acid encoding a polypeptide comprising a second antigen-binding domain, wherein each of the two antigen-binding domains comprises one or more amino acid residues from which a bond for linking the two antigen-binding domains originates,
(b) introducing a mutation into the nucleic acids encoding the two antigen-binding domains such that another bond linking the two antigen-binding domains is added,
(c) introducing the nucleic acids produced in (b) into a host cell,
(d) culturing the host cell such that the two polypeptides are expressed, and
(e) obtaining an antigen-binding molecule which is a polypeptide comprising the first and second antigen-binding domains, wherein the two antigen-binding domains are linked with each other via two or more bonds.

In certain embodiments, some or all of the one or more amino acid residues recited in (a) above from which the bond between the antigen-binding domains originates are amino acid residues which are present in a wild-type Fab or hinge region (for example, cysteine residues in the hinge region). In a further embodiment, said another bond recited in (b) above is a bond in which the amino acid residues from which the bond between the antigen-binding domains originates are derived from mutated amino acid residues which are not present in a wild-type Fab or hinge region (for example, cysteine residues which are not present in the wild-type Fab or hinge region).

Further, in another aspect, the present disclosure provides a method for producing an antigen-binding molecule which has activity of regulating activation of two antigen molecules which are activated by association with each other, comprising:
(a) providing a nucleic acid encoding a polypeptide comprising a first antigen-binding domain and a nucleic acid encoding a polypeptide comprising a second antigen-binding domain, wherein each of the two antigen-binding domains comprises one or more amino acid residues from which a bond for linking the two antigen-binding domains originates,
(b) introducing a mutation into the nucleic acids encoding the two antigen-binding domains such that another bond linking the two antigen-binding domains is added,
(c) introducing the nucleic acids produced in (b) into a host cell,
(d) culturing the host cell such that the two polypeptides are expressed, and
(e) obtaining an antigen-binding molecule which is a polypeptide comprising the first and second antigen-binding domains, wherein the two antigen-binding domains are linked with each other via two or more bonds.

In certain embodiments, some or all of the one or more amino acid residues recited in (a) above from which the bond between the antigen-binding domains originates are amino acid residues which are present in a wild-type Fab or hinge region (for example, cysteine residues in the hinge region). In a further embodiment, said another bond recited in (b) above is a bond in which the amino acid residues from which the bond between the antigen-binding domains originates are derived from mutated amino acid residues which are not present in a wild-type Fab or hinge region (for example, cysteine residues which are not present in the wild-type Fab or hinge region).

Furthermore, in another aspect, the present disclosure provides a method for producing an antigen-binding molecule which has increased resistance to protease cleavage, comprising:
(a) providing a nucleic acid encoding a polypeptide comprising a first antigen-binding domain and a nucleic acid encoding a polypeptide comprising a second antigen-binding domain, wherein each of the two antigen-binding domains comprises one or more amino acid residues from which a bond for linking the two antigen-binding domains originates,
(b) introducing a mutation into the nucleic acids encoding the two antigen-binding domains such that another bond linking the two antigen-binding domains is added,
(c) introducing the nucleic acids produced in (b) into a host cell,
(d) culturing the host cell such that the two polypeptides are expressed, and
(e) obtaining an antigen-binding molecule which is a polypeptide comprising the first and second antigen-binding domains, wherein the two antigen-binding domains are linked with each other via two or more bonds.

In certain embodiments, some or all of the one or more amino acid residues recited in (a) above from which the bond between the antigen-binding domains originates are amino acid residues which are present in a wild-type Fab or hinge region (for example, cysteine residues in the hinge region). In a further embodiment, said another bond recited in (b) above is a bond in which the amino acid residues from which the bond between the antigen-binding domains originates are derived from mutated amino acid residues which are not present in a wild-type Fab or hinge region (for example, cysteine residues which are not present in the wild-type Fab or hinge region).

The antigen-binding molecule produced in these various aspects may have the characteristics of the antigen-binding molecules described herein.

<Methods of Screening for Antigen-Binding Molecules>

In another aspect, the present disclosure provides a method for identifying a novel pair of protein molecules which are activated by association with each other, comprising:
(a) providing two arbitrary protein molecules,
(b) producing, by the production method of the present disclosure, an antigen-binding molecule comprising two antigen-binding domains which respectively bind to the two protein molecules, wherein the antigen-binding molecule has activity of holding the two protein molecules at close positions,
(c) contacting the antigen-binding molecule produced in (b) with the two protein molecules, and
(d) assessing whether or not the two protein molecules are activated.

In certain embodiments, at least one of the protein molecules is selected from the group consisting of receptors belonging to cytokine receptor superfamilies, G protein-coupled receptors, ion channel receptors, tyrosine kinase receptors, immune checkpoint receptors, antigen receptors, CD antigens, costimulatory molecules, and cell adhesion molecules.

<Linkage of Antigen-Binding Domains>

In a non-limiting embodiment, two or more antigen-binding domains contained in an antigen-binding molecule of the present disclosure are linked with each other via one or more bonds. In a preferred embodiment, an antigen-binding domain contained in an antigen-binding molecule of the present disclosure has, by itself, activity to bind to an antigen. In such an embodiment, the antigen-binding molecule of the present disclosure containing two antigen-binding domains can bind to two or more antigen molecules; the antigen-binding molecule of the present disclosure containing three antigen-binding domains can bind to three or more antigen molecules; the antigen-binding molecule of the present disclosure containing four antigen-binding domains can bind to four or more antigen molecules; and the antigen-binding molecule of the present disclosure containing N antigen-binding domains can bind to N or more antigen molecules.

In certain embodiments, at least one of the bonds between the antigen-binding domains contained in an antigen-binding molecule of the present disclosure is different from a bond found in a naturally-occurring antibody (for example, in a wild-type Fab or hinge region). Examples of the bonds found between the antigen-binding domains of a naturally-occurring antibody (for example, naturally-occurring IgG antibody) include disulfide bonds in the hinge region. Bonds between amino acid residues positioned in a region other than the hinge region may be bonds between amino acid residues within an antibody fragment (for example, Fab), and they include bonds between the heavy chains (HH), bonds between the light chains (LL), and bonds between the heavy and light chains (HL or LH) (see FIG. 1). Examples of the amino acid residues in the heavy or light chain from which the bonds between the antigen-binding domains originate include amino acid residues at the above-mentioned positions within the variable region (VH region or VL region) or within the constant region (CH1 region, hinge region, or CL region).

In a non-limiting embodiment, the bonds between the antigen-binding domains may originate from multiple amino acid residues present at positions separate from each other in the primary structure in at least one of two or more antigen-binding domains contained in an antigen-binding molecule of the present disclosure. The distance between the multiple amino acid residues is a distance that allows the achievement of the structures of two or more, sufficiently close antigen-binding domains as a result of linkage between the antigen-binding domains by the bonds which originate from the amino acid residues. The distance between the multiple amino acid residues may be, for example, 4 amino acids or more, 5 amino acids or more, 6 amino acids or more, 7 amino acids or more, 8 amino acids or more, 9 amino acids or more, 10 amino acids or more, 11 amino acids or more, 12 amino acids or more, 13 amino acids or more, 14 amino acids or more, 15 amino acids or more, 20 amino acids or more, 25 amino acids or more, 30 amino acids or more, 35 amino acids or more, 40 amino acids or more, 45 amino acids or more, 50 amino acids or more, 60 amino acids or more, 70 amino acids or more, 80 amino acids or more, 90 amino acids or more, 100 amino acids or more, 110 amino acids or more, 120 amino acids or more, 130 amino acids or more, 140 amino acids or more, 150 amino acids or more, 160 amino acids or more, 170 amino acids or more, 180 amino acids or more, 190 amino acids or more, 200 amino acids or more, 210 amino acids or more, or 220 amino acids or more.

Further, the number of the bonds between the antigen-binding domains and the number of the amino acid residues from which the bonds originate are a number that allows the achievement of the structures of two or more, sufficiently close antigen-binding domains as a result of linkage between the antigen-binding domains by the bonds. The number may be, for example, two or more, three or more, four or more, five or more, six or more, seven or more, eight or more, nine or more, or ten or more.

In certain embodiments, as long as the structures of two or more, sufficiently close antigen-binding domains are achieved as a result of linkage between the antigen-binding domains by three or more bonds which respectively originate from three or more amino acid residues in the antigen-binding domains, the distance in the primary structure between any two amino acid residues selected from the three amino acid residues may be seven amino acids or more in at least one amino acid residue pair, and may be less than seven amino acids in the remainder of amino acid residue pairs.

In connection with antigen-binding domains contained in antigen-binding molecules of the present disclosure, "sufficiently close" means that two or more antigen-binding domains are close to the extent that this is sufficient for achieving the desired functions (activities) of the antigen-binding molecule of the present disclosure. Examples of the desired functions (activities) include activity of holding two antigen molecules at spatially close positions; activity of regulating interaction between two antigen molecules; activity of promoting activation of a receptor by a ligand; activity of promoting catalytic reaction of an enzyme with a substrate; activity of promoting interaction between a cell expressing a first antigen and a cell expressing a second antigen; activity of promoting damage of a target cell by a cell with cytotoxic activity (such as a T cell, NK cell, monocyte, macrophage); activity of regulating activation of two antigen molecules which are activated by association with each other; and resistance to protease cleavage of the antigen-binding molecules.

In a non-limiting embodiment, the bond between the antigen-binding domains contained in an antigen-binding molecule of the present disclosure may be a covalent bond or a non-covalent bond. The covalent bond may be a covalent bond formed by directly crosslinking an amino acid residue in a first antigen-binding domain and an amino acid residue of a second antigen-binding domain, for example, a disulfide bond between cysteine residues. The directly crosslinked amino acid residue may be present in an antibody fragment such as Fab, or within a hinge region.

In another embodiment, a covalent bond is formed by crosslinking an amino acid residue in a first antigen-binding domain and an amino acid residue of a second antigen-binding domain via a crosslinking agent. For example, when an amine-reactive crosslinking agent is used for crosslinking, the crosslinkage can be made via a free amino group of the N-terminal amino acid of the antigen-binding domain, or a primary amine of the side chain of a lysine residue in the antigen-binding domain. Amine-reactive crosslinking agents include a functional group that forms a chemical bond with a primary amine, such as isothiocyanate, isocyanate, acyl azide, NHS ester, sulfonyl chloride, aldehyde, glyoxal, epoxide, oxirane, carbonate, aryl halide, imide ester, carbodiimide, anhydride, and fluoroester. Representative examples include DSG (disuccinimidyl glutarate), DSS (disuccinimidyl suberate), BS3 (bis(sulfosuccinimidyl) suberate), DSP (dithiobis(succinimidyl propionate)), DTSSP (3,3'-dithiobis (sulfosuccinimidyl propionate)), DST (disuccinimidyl tartrate), BSOCOES (bis(2-(succinimidooxycarbonyloxy) ethyl)sulfone), EGS (ethylene glycol bis(succinimidyl succinate)), Sulfo-EGS (ethylene glycol bis (sulfosuccinimidyl succinate)), DMA (dimethyl adipimidate), DMP (dimethyl pimelimidate), DMS (dimethyl suberimidate), and DFDNB (1,5-difluoro-2,4-dinitrobenzene). Examples of other crosslinking agents include carboxyl/amine-reactive, sulfhydryl-reactive, aldehyde-reactive, and light-reactive crosslinking agents.

The non-covalent bond for linking the antigen-binding domains may be an ionic bond, hydrogen bond, or hydrophobic bond.

Whether the number of the bonds between the antigen-binding domains is larger than that of a control antigen-binding molecule (e.g., an antigen-binding molecule having a structure substantially similar to a naturally-occurring antibody structure) can be assessed by, for example, the following method. First, an antigen-binding molecule of interest and a control antigen-binding molecule are treated with a protease that cuts out the antigen-binding domain (for example, a protease that cleaves the N-terminal side of the crosslinkage site of the hinge regions such as papain and Lys-C), and then subjected to non-reducing electrophoresis. Next, an antibody that recognizes a part of the antigen-binding domain (for example, anti-kappa chain HRP-labelled antibody) is used to detect fragments which are present after the protease treatment. When only a monomer of the antigen-binding domain (for example, Fab monomer) is detected for the control antigen-binding molecule, and a multimer of the antigen-binding domain (for example, Fab dimer) is detected for the antigen-binding molecule of interest, then it can be assessed that the number of the bonds between the antigen-binding domains of the antigen-binding molecule of interest is larger than that of the control antigen-binding molecule.

The formation of a disulfide bond between cysteines in a modified antigen-binding molecule produced by introducing cysteines into a control antigen-binding molecule can be assessed by, for example, the following method. First, an antigen-binding molecule of interest is incubated with chymotrypsin in 20 mM phosphate buffer (pH7.0), and then the mass of peptides expected to be generated from the amino acid sequence of each antibody is detected by LC/MS. If a component corresponding to the theoretical mass of a peptide that should be generated when the newly-introduced cysteines form a disulfide bond is detected, the introduced cysteines can be assessed as having formed a disulfide bond. Moreover, if this component becomes undetectable when the sample containing the above-mentioned antigen-binding molecule is analyzed after adding an agent for reducing disulfide bonds (for example, tris(2-carboxyethyl)phosphine) to the sample, the correctness of the above assessment will be further strongly verified.

<Resistance to Protease Cleavage>

In anon-limiting embodiment, the antigen-binding molecule of the present disclosure has resistance to protease cleavage. In certain embodiments, the resistance to protease cleavage of the antigen-binding molecule of the present disclosure is increased compared with a control antigen-binding molecule (for example, an antigen-binding molecule having a structure substantially similar to a naturally-occurring antibody structure) where the number of bonds between the antigen-binding domains is lesser by one or more compared to the antigen-binding molecule. In a further embodiment, the one less bond can be selected from bonds in which the amino acid residues from which the bonds between the antigen-binding domains originate are derived from mutated amino acid residues which are not present in a wild-type Fab or hinge region (for example, cysteine residues which are not present in the wild-type Fab or hinge region). If the proportion of the full-length molecule (for example, full-length IgG molecule) remaining after protease treatment is increased, or the proportion of a particular fragment (for example, Fab monomer) produced after protease treatment is reduced for an antigen-binding molecule compared to a control antigen-binding molecule, then it can be assessed that the resistance to protease cleavage is increased (protease resistance is improved).

In certain embodiments, the proportion of the full-length molecule remaining after protease treatment may be, relative to all antigen-binding molecules, for example, 0.5% or more, 1% or more, 1.5% or more, 2% or more, 2.5% or more, 3% or more, 3.5% or more, 4% or more, 4.5% or more, 5% or more, 7.5% or more, 10% or more, 12.5% or more, 15% or more, 20% or more, 25% or more, 30% or more, 35% or more, 40% or more, 45% or more, or 50% or more. In certain other embodiments, the proportion of a monomer of an antigen-binding domain (for example, Fab) produced after protease treatment may be, relative to all antigen-binding molecules, for example, 99% or less, 98% or less, 97% or less, 96% or less, 95% or less, 94% or less, 93% or less, 92% or less, 91% or less, 90% or less, 85% or less, 80% or less, 75% or less, 70% or less, 60% or less, 50% or less, 40% or less, 30% or less, 20% or less, or 10% or less. In certain other embodiments, the proportion of a dimer of an antigen-binding domain (for example, Fab) produced after protease treatment may be, relative to all antigen-binding molecules, for example, 0.5% or more, 1% or more, 1.5% or more, 2% or more, 2.5% or more, 3% or more, 3.5% or more, 4% or more, 4.5% or more, 5% or more, 7.5% or more, 10% or more, 12.5% or more, 15% or more, 20% or more, 25% or more, 30% or more, 35% or more, 40% or more, 45% or more, or 50% or more.

Examples of proteases include, but are not limited to, Lys-C, plasmin, human neutrophil elastase (HNE), and papain.

In a further aspect, an antigen-binding molecule according to any of the above embodiments may incorporate any of the features, singly or in combination, as described in Sections 1-7 below:

1. Antigen-Binding Molecule Affinity

In certain embodiments, an antigen-binding molecule provided herein has a dissociation constant (KD) of 1 micro M or less, 100 nM or less, 10 nM or less, 1 nM or less, 0.1 nM or less, 0.01 nM or less, or 0.001 nM or less (e.g., $10^{-8}$ M or less, e.g., from $10^{-8}$ M to $10^{-13}$ M, e.g., from $10^{-9}$ M to $10^{-13}$ M).

2 Antibody Fragments

In certain embodiments, an antigen-binding molecule provided herein is an antibody fragment. Antibody fragments include, but are not limited to, Fab, Fab', Fab'-SH, F(ab')2, Fv, and scFv fragments, and other fragments described herein. For a review of certain antibody fragments, see Hudson et al. *Nat. Med.* 9:129-134 (2003). For a review of scFv fragments, see, e.g., Pluckthifn, in *The Pharmacology of Monoclonal Antibodies, vol.* 113, Rosenburg and Moore eds., (Springer-Verlag, New York), pp. 269-315 (1994); see also WO 93/16185; and U.S. Pat. Nos. 5,571,894 and 5,587,458. For discussion of Fab and F(ab')2 fragments comprising salvage receptor binding epitope residues and having increased in vivo half-life, see U.S. Pat. No. 5,869,046.

Diabodies are antibody fragments with two antigen-binding sites that may be bivalent or bispecific. See, for example, EP 404,097; WO 1993/01161; Hudson et al., *Nat. Med.* 9:129-134 (2003); and Hollinger et al., *Proc. Natl. Acad. Sci. USA* 90: 6444-6448 (1993). Triabodies and tetrabodies are also described in Hudson et al., *Nat. Med.* 9:129-134 (2003).

3. Chimeric and Humanized Antibodies

In certain embodiments, an antigen-binding molecule provided herein is a chimeric antibody. Certain chimeric antibodies are described, e.g., in U.S. Pat. No. 4,816,567; and Morrison et al., *Proc. Natl. Acad. Sci. USA,* 81:6851-6855 (1984)). In one example, a chimeric antibody comprises a non-human variable region (e.g., a variable region derived from a mouse, rat, hamster, rabbit, or non-human primate, such as a monkey) and a human constant region. In a further example, a chimeric antibody is a "class switched" antibody in which the class or subclass has been changed from that of the parent antibody. Chimeric antibodies include antigen-binding fragments thereof.

In certain embodiments, a chimeric antibody is a humanized antibody. Typically, a non-human antibody is humanized to reduce immunogenicity to humans, while retaining the specificity and affinity of the parental non-human antibody. Generally, a humanized antibody comprises one or more variable domains in which HVRs, e.g., CDRs, (or portions thereof) are derived from a non-human antibody, and FRs (or portions thereof) are derived from human antibody sequences. A humanized antibody optionally will also comprise at least a portion of a human constant region. In some embodiments, some FR residues in a humanized antibody are substituted with corresponding residues from a non-human antibody (e.g., the antibody from which the HVR residues are derived), e.g., to restore or improve antibody specificity or affinity.

4. Human Antibodies

In certain embodiments, an antigen-binding molecule provided herein is a human antibody. Human antibodies can be produced using various techniques known in the art. Human antibodies are described generally in van Dijk and van de Winkel, *Curr. Opin. Pharmacol.* 5: 368-74 (2001) and Lonberg, *Curr. Opin. Immunol.* 20:450-459 (2008).

5. Library-Derived Antigen-Binding Molecules

Antigen-binding molecules of the invention may be isolated by screening combinatorial libraries for antigen-binding molecules with the desired activity or activities. For example, a variety of methods are known in the art for generating phage display libraries and screening such libraries for antigen-binding molecules possessing the desired binding characteristics. Such methods are reviewed, e.g., in Hoogenboom et al. in *Methods in Molecular Biology* 178: 1-37 (O'Brien et al., ed., Human Press, Totowa, NJ, 2001) and further described, e.g., in the McCafferty et al., *Nature* 348:552-554; Clackson et al., *Nature* 352: 624-628 (1991); Marks et al., *J. Mol. Biol.* 222: 581-597 (1992); Marks and Bradbury, in *Methods in Molecular Biology* 248:161-175 (Lo, ed., Human Press, Totowa, NJ, 2003); Sidhu et al., *J. Mol. Biol.* 338(2): 299-310 (2004); Lee et al., *J. Mol. Biol.* 340(5): 1073-1093 (2004); Fellouse, *Proc. Natl. Acad. Sci. USA* 101(34): 12467-12472 (2004); and Lee et al., *J. Immunol. Methods* 284(1-2): 119-132(2004).

6. Multispecific Antigen-Binding Molecules

In certain embodiments, an antigen-binding molecule provided herein is a multispecific antigen-binding molecule, e.g. a bispecific antigen-binding molecule. Multispecific antigen-binding molecules are monoclonal antigen-binding molecules that have binding specificities for at least two different sites. In certain embodiments, one of the binding specificities is for a particular antigen (e.g., CD3) and the other is for any other antigen (e.g., CD28 or cancer antigen). In certain embodiments, bispecific antigen-binding molecules may bind to two different epitopes on a single antigen. Bispecific antigen-binding molecules can be prepared as full length antibodies or antibody fragments.

Techniques for making multispecific antigen-binding molecules include, but are not limited to, recombinant co-expression of two immunoglobulin heavy chain-light chain pairs having different specificities (see Milstein and Cuello, *Nature* 305: 537 (1983)), WO 93/08829, and Traunecker et al., *EMBO J.* 10: 3655 (1991)), and "knob-in-hole" engineering (see, e.g., U.S. Pat. No. 5,731,168). Multispecific antigen-binding molecules may also be made by engineering electrostatic steering effects for making antibody Fc-heterodimeric molecules (WO 2009/089004A1); cross-linking two or more antibodies or fragments (see, e.g., U.S. Pat. No. 4,676,980, and Brennan et al., *Science,* 229: 81 (1985)); using leucine zippers to produce bi-specific antibodies (see, e.g., Kostelny et al., *J. Immunol.,* 148(5):1547-1553 (1992)); using "diabody" technology for making bispecific antibody fragments (see, e.g., Hollinger et al., *Proc. Natl. Acad. Sci. USA,* 90:6444-6448 (1993)); and using single-chain Fv (scFv) dimers (see, e.g. Gruber et al., *J. Immunol.,* 152:5368 (1994)); and preparing trispecific antibodies as described, e.g., in Tutt et al. *J. Immunol.* 147: 60 (1991).

Engineered antibodies with three or more functional antigen binding sites, including "Octopus antibodies," are also included herein (see, e.g. US 2006/0025576A1).

7. Antigen-Binding Molecule Variants

In certain embodiments, amino acid sequence variants of the antigen-binding molecules provided herein are contemplated. For example, it may be desirable to improve the binding affinity and/or other biological properties of the antigen-binding molecule. Amino acid sequence variants of an antigen-binding molecule may be prepared by introducing appropriate modifications into the nucleotide sequence encoding the antigen-binding molecule, or by peptide synthesis. Such modifications include, for example, deletions from, and/or insertions into and/or substitutions of residues within the amino acid sequences of the antigen-binding molecule. Any combination of deletion, insertion, and substitution can be made to arrive at the final construct, provided that the final construct possesses the desired characteristics, e.g., antigen-binding.

a) Substitution, Insertion, and Deletion Variants

In certain embodiments, antigen-binding molecule variants having one or more amino acid substitutions are provided. Sites of interest for substitutional mutagenesis include the HVRs and FRs. Conservative substitutions are shown the table below under the heading of "preferred substitutions." More substantial changes are provided in the table under the heading of "exemplary substitutions," and as further described below in reference to amino acid side chain classes. Amino acid substitutions may be introduced into an antigen-binding molecule of interest and the products screened for a desired activity, e.g., retained/improved antigen binding, decreased immunogenicity, or improved ADCC or CDC.

TABLE 1

| Original Residue | Exemplary Substitutions | Preferred Substitutions |
|---|---|---|
| Ala (A) | Val; Leu; Ile | Val |
| Arg (R) | Lys; Gln; Asn | Lys |
| Asn (N) | Gln; His; Asp, Lys; Arg | Gln |
| Asp (D) | Glu; Asn | Glu |
| Cys (C) | Ser; Ala | Ser |
| Gln (Q) | Asn; Glu | Asn |
| Glu (E) | Asp; Gln | Asp |
| Gly (G) | Ala | Ala |
| His (H) | Asn; Gln; Lys; Arg | Arg |
| Ile (I) | Leu; Val; Met; Ala; Phe; Norleucine | Leu |
| Leu (L) | Norleucine; Ile; Val; Met; Ala; Phe | Ile |
| Lys (K) | Arg; Gln; Asn | Arg |
| Met (M) | Leu; Phe; Ile | Leu |
| Phe (F) | Trp; Leu; Val; Ile; Ala; Tyr | Tyr |
| Pro (P) | Ala | Ala |
| Ser (S) | Thr | Thr |
| Thr (T) | Val; Ser | Ser |
| Trp (W) | Tyr; Phe | Tyr |
| Tyr (Y) | Trp; Phe; Thr; Ser | Phe |
| Val (V) | Ile; Leu; Met; Phe; Ala; Norleucine | Leu |

Amino acids may be grouped according to common side-chain properties:

(1) hydrophobic: Norleucine, Met, Ala, Val, Leu, Ile;
(2) neutral hydrophilic: Cys, Ser, Thr, Asn, Gln;
(3) acidic: Asp, Glu;
(4) basic: His, Lys, Arg;
(5) residues that influence chain orientation: Gly, Pro;
(6) aromatic: Trp, Tyr, Phe.

Non-conservative substitutions will entail exchanging a member of one of these classes for another class.

One type of substitutional variant involves substituting one or more hypervariable region residues of a parent antigen-binding molecule (e.g. a humanized or human antibody). Generally, the resulting variant(s) selected for further study will have modifications (e.g., improvements) in certain biological properties (e.g., increased affinity, reduced immunogenicity) relative to the parent antigen-binding molecule and/or will have substantially retained certain biological properties of the parent antigen-binding molecule. An exemplary substitutional variant is an affinity matured antibody, which may be conveniently generated, e.g., using phage display-based affinity maturation techniques such as those described herein. Briefly, one or more HVR residues are mutated and the variant antibodies displayed on phage and screened for a particular biological activity (e.g. binding affinity).

Alterations (e.g., substitutions) may be made in HVRs, e.g., to improve antigen-binding molecule affinity. Such alterations may be made in HVR "hotspots," i.e., residues encoded by codons that undergo mutation at high frequency during the somatic maturation process (see, e.g., Chowdhury, Methods *Mol. Biol.* 207:179-196 (2008)), and/or residues that contact antigen, with the resulting variant VH or VL being tested for binding affinity. Affinity maturation by constructing and reselecting from secondary libraries has been described, e.g., in Hoogenboom et al. in *Methods in Molecular Biology* 178:1-37 (O'Brien et al., ed., Human Press, Totowa, NJ, (2001).) In some embodiments of affinity maturation, diversity is introduced into the variable genes chosen for maturation by any of a variety of methods (e.g., error-prone PCR, chain shuffling, or oligonucleotide-directed mutagenesis). A secondary library is then created. The library is then screened to identify any antigen-binding molecule variants with the desired affinity. Another method to introduce diversity involves HVR-directed approaches, in which several HVR residues (e.g., 4-6 residues at a time) are randomized. HVR residues involved in antigen binding may be specifically identified, e.g., using alanine scanning mutagenesis or modeling. CDR-H3 and CDR-L3 in particular are often targeted.

In certain embodiments, substitutions, insertions, or deletions may occur within one or more HVRs so long as such alterations do not substantially reduce the ability of the antigen-binding molecule to bind antigen. For example, conservative alterations (e.g., conservative substitutions as provided herein) that do not substantially reduce binding affinity may be made in HVRs. Such alterations may, for example, be outside of antigen contacting residues in the HVRs. In certain embodiments of the variant VH and VL sequences provided above, each HVR either is unaltered, or contains no more than one, two or three amino acid substitutions.

A useful method for identification of residues or regions of an antigen-binding molecule that may be targeted for mutagenesis is called "alanine scanning mutagenesis" as described by Cunningham and Wells (1989) Science, 244: 1081-1085. In this method, a residue or group of target residues (e.g., charged residues such as arg, asp, his, lys, and glu) are identified and replaced by a neutral or negatively charged amino acid (e.g., alanine or polyalanine) to determine whether the interaction of the antigen-binding molecule with antigen is affected. Further substitutions may be introduced at the amino acid locations demonstrating functional sensitivity to the initial substitutions. Alternatively, or additionally, a crystal structure of a complex of antigens and an antigen-binding molecule may be analyzed to identify contact points between the antigen-binding molecule and antigen. Such contact residues and neighboring residues may be targeted or eliminated as candidates for substitution. Variants may be screened to determine whether they contain the desired properties.

Amino acid sequence insertions include amino- and/or carboxyl-terminal fusions ranging in length from one residue to polypeptides containing a hundred or more residues, as well as intrasequence insertions of single or multiple amino acid residues. Examples of terminal insertions include an antigen-binding molecule with an N-terminal methionyl residue. Other insertional variants of the antigen-binding molecule include the fusion of an enzyme (e.g. for ADEPT) or a polypeptide which increases the plasma half-life of the antigen-binding molecule to the N- or C-terminus of the antigen-binding molecule.

b) Glycosylation Variants

In certain embodiments, an antigen-binding molecule provided herein is altered to increase or decrease the extent to which the antigen-binding molecule is glycosylated. Addition or deletion of glycosylation sites to an antigen-binding molecule may be conveniently accomplished by altering the amino acid sequence such that one or more glycosylation sites is created or removed.

Where the antigen-binding molecule comprises an Fc region, the carbohydrate attached thereto may be altered. Native antibodies produced by mammalian cells typically comprise a branched, biantennary oligosaccharide that is generally attached by an N-linkage to Asn297 of the CH2 domain of the Fc region. See, e.g., Wright et al. *TIBTECH* 15:26-32 (1997). The oligosaccharide may include various carbohydrates, e.g., mannose, N-acetyl glucosamine (GlcNAc), galactose, and sialic acid, as well as a fucose attached to a GlcNAc in the "stem" of the biantennary oligosaccharide structure. In some embodiments, modifications of the oligosaccharide in an antigen-binding molecule of the invention may be made in order to create antigen-binding molecule variants with certain improved properties.

In one embodiment, antigen-binding molecule variants are provided having a carbohydrate structure that lacks fucose attached (directly or indirectly) to an Fc region. For example, the amount of fucose in such antigen-binding molecule may be from 1% to 80%, from 1% to 65%, from 5% to 65% or from 20% to 40%. The amount of fucose is determined by calculating the average amount of fucose within the sugar chain at Asn297, relative to the sum of all glycostructures attached to Asn 297 (e.g. complex, hybrid and high mannose structures) as measured by MALDI-TOF mass spectrometry, as described in WO 2008/077546, for example. Asn297 refers to the asparagine residue located at about position 297 in the Fc region (EU numbering of Fc region residues); however, Asn297 may also be located about +/−3 amino acids upstream or downstream of position 297, i.e., between positions 294 and 300, due to minor sequence variations in antigen-binding molecules. Such fucosylation variants may have improved ADCC function. See, e.g., US Patent Publication Nos. US 2003/0157108 (Presta, L.); US 2004/0093621 (Kyowa Hakko Kogyo Co., Ltd). Examples of publications related to "defucosylated" or "fucose-deficient" antigen-binding molecule variants include: US 2003/0157108; WO 2000/61739; WO 2001/29246; US 2003/0115614; US 2002/0164328; US 2004/0093621; US 2004/0132140; US 2004/0110704; US 2004/0110282; US 2004/0109865; WO 2003/085119; WO 2003/084570; WO 2005/035586; WO 2005/035778; WO2005/053742; WO2002/031140; Okazaki et al. *J. Mol. Biol.* 336:1239-1249 (2004); Yamane-Ohnuki et al. Biotech. Bioeng. 87: 614 (2004). Examples of cell lines capable of producing defucosylated antigen-binding molecules include Lec13 CHO cells deficient in protein fucosylation (Ripka et al. *Arch. Biochem. Biophys.* 249:533-545 (1986); US Pat Appl No US 2003/0157108 A1, Presta, L; and WO 2004/056312 A1, Adams et al., especially at Example 11), and knockout cell lines, such as alpha-1,6-fucosyltransferase gene, *FUT*8. knockout CHO cells (see, e.g., Yamane-Ohnuki et al. *Biotech. Bioeng.* 87: 614 (2004); Kanda, Y. et al., *Biotechnol. Bioeng.,* 94(4):680-688 (2006); and WO2003/085107).

Antigen-binding molecule variants are further provided with bisected oligosaccharides, e.g., in which a biantennary oligosaccharide attached to the Fc region of the antigen-binding molecule is bisected by GlcNAc. Such antigen-binding molecule variants may have reduced fucosylation and/or improved ADCC function. Examples of such antibody variants are described, e.g., in WO 2003/011878 (Jean-Mairet et al.); U.S. Pat. No. 6,602,684 (Umana et al.); and US 2005/0123546 (Umana et al.). Antigen-binding molecule variants with at least one galactose residue in the oligosaccharide attached to the Fc region are also provided. Such antigen-binding molecule variants may have improved CDC function. Such antigen-binding molecule variants are described, e.g., in WO 1997/30087 (Patel et al.); WO 1998/58964 (Raju, S.); and WO 1999/22764 (Raju, S.).

c) Fc Region Variants

In certain embodiments, one or more amino acid modifications may be introduced into the Fc region of an antigen-binding molecule provided herein, thereby generating an Fc region variant. The Fc region variant may comprise a human Fc region sequence (e.g., a human IgG1, IgG2, IgG3 or IgG4 Fc region) comprising an amino acid modification (e.g. a substitution) at one or more amino acid positions.

In certain embodiments, the invention contemplates an antigen-binding molecule variant that possesses some but not all effector functions, which make it a desirable candidate for applications in which the half life of the antigen-binding molecule in vivo is important yet certain effector functions (such as complement and ADCC) are unnecessary or deleterious. In vitro and/or in vivo cytotoxicity assays can be conducted to confirm the reduction/depletion of CDC and/or ADCC activities. For example, Fc receptor (FcR) binding assays can be conducted to ensure that the antigen-binding molecule lacks Fc gamma R binding (hence likely lacking ADCC activity), but retains FcRn binding ability. The primary cells for mediating ADCC, NK cells, express Fc gamma RIII only, whereas monocytes express Fc gamma RI, Fc gamma RII and Fc gamma RIII. FcR expression on hematopoietic cells is summarized in Table 3 on page 464 of Ravetch and Kinet, Annu. Rev. Immunol. 9:457-492 (1991). Non-limiting examples of in vitro assays to assess ADCC activity of a molecule of interest is described in U.S. Pat. No. 5,500,362 (see, e.g. Hellstrom, I. et al. *Proc. Nat'l Acad. Sci. USA* 83:7059-7063 (1986)) and Hellstrom, I et al., *Proc. Nat'l Acad. Sci. USA* 82:1499-1502 (1985); 5,821,337 (see Bruggemann, M. et al., *J. Exp. Med.* 166:1351-1361 (1987)). Alternatively, non-radioactive assays methods may be employed (see, for example, ACTI™ non-radioactive cytotoxicity assay for flow cytometry (CellTechnology, Inc. Mountain View, CA; and CytoTox 96 (registered trademark) non-radioactive cytotoxicity assay (Promega, Madison, WI). Useful effector cells for such assays include peripheral blood mononuclear cells (PBMC) and Natural Killer (NK) cells. Alternatively, or additionally, ADCC activity of the molecule of interest may be assessed in vivo, e.g., in an animal model such as that disclosed in Clynes et al. *Proc. Nat'l Acad. Sci. USA* 95:652-656 (1998). C1q binding assays may also be carried out to confirm that the antigen-binding molecule is unable to bind C1q and hence lacks CDC activity. See, e.g., C1q and C3c binding ELISA in WO 2006/029879 and WO 2005/100402. To assess complement activation, a CDC assay may be performed (see, for example, Gazzano-Santoro et al., *J. Immunol. Methods* 202:163 (1996); Cragg, M. S. et al., *Blood* 101:1045-1052 (2003); and Cragg, M. S. and M. J. Glennie, *Blood* 103: 2738-2743 (2004)). FcRn binding and in vivo clearance/half life determinations can also be performed using methods known in the art (see, e.g., Petkova, S. B. et al., *Int'l. Immunol.* 18(12):1759-1769 (2006)).

Antigen-binding molecules with reduced effector function include those with substitution of one or more of Fc region residues 238, 265, 269, 270, 297, 327 and 329 (U.S. Pat. No. 6,737,056). Such Fc mutants include Fc mutants with substitutions at two or more of amino acid positions 265, 269, 270, 297 and 327, including the so-called "DANA" Fc mutant with substitution of residues 265 and 297 to alanine (U.S. Pat. No. 7,332,581).

Certain antigen-binding molecule variants with increased or decreased binding to FcRs are described. (See, e.g., U.S. Pat. No. 6,737,056; WO 2004/056312, and Shields et al., *J. Biol. Chem.* 9(2): 6591-6604 (2001).)

In certain embodiments, an antigen-binding molecule variant comprises an Fc region with one or more amino acid substitutions which improve ADCC, e.g., substitutions at positions 298, 333, and/or 334 of the Fc region (EU numbering of residues).

In some embodiments, alterations are made in the Fc region that result in altered (i.e., either increased or decreased) C1q binding and/or Complement Dependent Cytotoxicity (CDC), e.g., as described in U.S. Pat. No. 6,194,551, WO 99/51642, and Idusogie et al. *J. Immunol.* 164: 4178-4184 (2000).

Antibodies with increased half lives and increased binding to the neonatal Fc receptor (FcRn), which is responsible for the transfer of maternal IgGs to the fetus (Guyer et al., *J. Immunol.* 117:587 (1976) and Kim et al., *J. Immunol.* 24:249 (1994)), are described in US2005/0014934A1 (Hinton et al.). Those antibodies comprise an Fc region with one or more substitutions therein which increase binding of the Fc region to FcRn. Such Fc variants include those with substitutions at one or more of Fc region residues: 238, 256, 265, 272, 286, 303, 305, 307, 311, 312, 317, 340, 356, 360, 362, 376, 378, 380, 382, 413, 424 or 434, e.g., substitution of Fc region residue 434 (U.S. Pat. No. 7,371,826).

See also Duncan & Winter, *Nature* 322:738-40 (1988); U.S. Pat. Nos. 5,648,260; 5,624,821; and WO 94/29351 concerning other examples of Fc region variants.

d) Cysteine engineered antigen-binding molecule variants

In certain embodiments, it may be desirable to create cysteine engineered antigen-binding molecules, e.g., "thio-MAbs," in which one or more residues of an antigen-binding molecule are substituted with cysteine residues. In particular embodiments, the substituted residues occur at accessible sites of the antigen-binding molecule. By substituting those residues with cysteine, reactive thiol groups are thereby positioned at accessible sites of the antigen-binding molecule and may be used to conjugate the antigen-binding molecule to other moieties, such as drug moieties or linker-drug moieties, to create an immunoconjugate, as described further herein. In certain embodiments, any one or more of the following residues may be substituted with cysteine: V205 (Kabat numbering) of the light chain; A118 (EU numbering) of the heavy chain; and S400 (EU numbering) of the heavy chain Fc region. Cysteine engineered antigen-binding molecules may be generated as described, e.g., in U.S. Pat. No. 7,521,541.

e) Antigen-Binding Molecule Derivatives

In certain embodiments, an antigen-binding molecule provided herein may be further modified to contain additional nonproteinaceous moieties that are known in the art and readily available. The moieties suitable for derivatization of the antigen-binding molecule include but are not limited to water soluble polymers. Non-limiting examples of water soluble polymers include, but are not limited to, polyethylene glycol (PEG), copolymers of ethylene glycol/propylene glycol, carboxymethylcellulose, dextran, polyvinyl alcohol, polyvinyl pyrrolidone, poly-1,3-dioxolane, poly-1,3,6-trioxane, ethylene/maleic anhydride copolymer, polyaminoacids (either homopolymers or random copolymers), and dextran or poly(n-vinyl pyrrolidone)polyethylene glycol, polypropylene glycol homopolymers, polypropylene oxide/ethylene oxide co-polymers, polyoxyethylated polyols (e.g., glycerol), polyvinyl alcohol, and mixtures thereof. Polyethylene glycol propionaldehyde may have advantages in manufacturing due to its stability in water. The polymer may be of any molecular weight, and may be branched or unbranched. The number of polymers attached to the antigen-binding molecule may vary, and if more than one polymer are attached, they can be the same or different molecules. In general, the number and/or type of polymers used for derivatization can be determined based on considerations including, but not limited to, the particular properties or functions of the antigen-binding molecule to be improved, whether the antigen-binding molecule derivative will be used in a therapy under defined conditions, etc.

In connection with an antigen-binding molecule in the present disclosure, examples of the desired property (activity) can include, but are not particularly limited to, binding activity, neutralizing activity, cytotoxic activity, agonist activity, antagonist activity, and enzymatic activity. The agonist activity is an activity of intracellularly transducing signals, for example, through the binding of an antibody to an antigen such as a receptor to induce change in some physiological activity. Examples of the physiological activity can include, but are not limited to, proliferative activity, survival activity, differentiation activity, transcriptional activity, membrane transport activity, binding activity, proteolytic activity, phosphorylating/dephosphorylating activity, redox activity, transfer activity, nucleolytic activity, dehydration activity, cell death-inducing activity, and apoptosis-inducing activity.

In another embodiment, conjugates of an antigen-binding molecule and nonproteinaceous moiety that may be selectively heated by exposure to radiation are provided. In one embodiment, the nonproteinaceous moiety is a carbon nanotube (Kam et al., *Proc. Natl. Acad. Sci. USA* 102: 11600-11605 (2005)). The radiation may be of any wavelength, and includes, but is not limited to, wavelengths that do not harm ordinary cells, but which heat the nonproteinaceous moiety to a temperature at which cells proximal to the antigen binding molecule-nonproteinaceous moiety are killed.

B. Recombinant Methods and Compositions

Antigen-binding molecules may be produced using recombinant methods and compositions, e.g., as described in U.S. Pat. No. 4,816,567. In one embodiment, isolated nucleic acid encoding an antigen-binding molecule in the present disclosure (a polypeptide comprising an antigen-binding domain described herein) is provided. Such nucleic acid may encode an amino acid sequence comprising the VL and/or an amino acid sequence comprising the VH of the antigen-binding molecule (e.g., the light and/or heavy chains of the antigen-binding molecule). In a further embodiment, one or more vectors (e.g., expression vectors) comprising such nucleic acid are provided. In a further embodiment, a host cell comprising such nucleic acid is provided. In one such embodiment, a host cell comprises (e.g., has been transformed with): (1) a vector comprising a nucleic acid that encodes an amino acid sequence comprising the VL of the antigen-binding molecule and an amino acid sequence comprising the VH of the antigen-binding molecule, or (2) a first vector comprising a nucleic acid that encodes an amino acid sequence comprising the VL of the antigen-binding molecule and a second vector comprising a nucleic acid that encodes an amino acid sequence comprising the VH of the antigen-binding molecule. In one embodiment, the host cell is eukaryotic, e.g. a Chinese Hamster Ovary (CHO) cell or lymphoid cell (e.g., Y0, NS0, Sp2/0 cell). In one embodiment, a method of making an antigen-binding molecule in the present disclosure is provided, wherein the method comprises culturing a host cell comprising a nucleic acid encoding the antigen-binding molecule, as provided above, under conditions suitable for expression of the antigen-binding molecule, and optionally recovering the antigen-binding molecule from the host cell (or host cell culture medium).

For recombinant production of an antigen-binding molecule in the present disclosure, nucleic acid encoding an antigen-binding molecule, e.g., as described above, is isolated and inserted into one or more vectors for further cloning and/or expression in a host cell. Such nucleic acid may be readily isolated and sequenced using conventional procedures (e.g., by using oligonucleotide probes that are capable of binding specifically to genes encoding the heavy and light chains of the antigen-binding molecule).

Suitable host cells for cloning or expression of antigen-binding molecule-encoding vectors include prokaryotic or eukaryotic cells described herein. For example, antigen-binding molecules may be produced in bacteria, in particular when glycosylation and Fc effector function are not needed. For expression of antibody fragments and polypeptides in bacteria, see, e.g., U.S. Pat. Nos. 5,648,237, 5,789,199, and 5,840,523. (See also Chariton, *Methods in Molecular Biology*, Vol. 248 (B. K. C. Lo, ed., Humana Press, Totowa, NJ, 2003), pp. 245-254, describing expression of antibody fragments in *E. coli*.) After expression, the antigen-binding molecule may be isolated from the bacterial cell paste in a soluble fraction and can be further purified.

In addition to prokaryotes, eukaryotic microbes such as filamentous fungi or yeast are suitable cloning or expression hosts for antigen-binding molecule-encoding vectors, including fungi and yeast strains whose glycosylation pathways have been "humanized," resulting in the production of an antigen-binding molecule with a partially or fully human glycosylation pattern. See Gemgross, *Nat. Biotech.* 22:1409-1414 (2004), and Li et al., *Nat. Biotech.* 24:210-215 (2006).

Suitable host cells for the expression of glycosylated antigen-binding molecule are also derived from multicellular organisms (invertebrates and vertebrates). Examples of invertebrate cells include plant and insect cells. Numerous baculoviral strains have been identified which may be used in conjunction with insect cells, particularly for transfection of *Spodoptera frugiperda* cells.

Plant cell cultures can also be utilized as hosts. See. e.g., U.S. Pat. Nos. 5,959,177, 6,040,498, 6,420,548, 7,125,978, and 6,417,429 (describing PLANTIBODIES™ technology for producing antigen-binding molecules in transgenic plants).

Vertebrate cells may also be used as hosts. For example, mammalian cell lines that are adapted to grow in suspension may be useful. Other examples of useful mammalian host cell lines are monkey kidney CV1 line transformed by SV40 (COS-7); human embryonic kidney line (293 or 293 cells as described, e.g., in Graham et al., *J. Gen Virol.* 36:59 (1977)); baby hamster kidney cells (BHK); mouse sertoli cells (TM4 cells as described, e.g., in Mather, *Biol. Reprod.* 23:243-251 (1980)); monkey kidney cells (CV1); African green monkey kidney cells (VERO-76); human cervical carcinoma cells (HELA); canine kidney cells (MDCK); buffalo rat liver cells (BRL 3A); human lung cells (W138); human liver cells (Hep G2); mouse mammary tumor (MMT 060562); TRI cells, as described, e.g., in Mather et al., *Annals N.Y. Acad. Sci.* 383:44-68 (1982); MRC 5 cells; and FS4 cells. Other useful mammalian host cell lines include Chinese hamster ovary (CHO) cells, including DHFR-CHO cells (Urlaub et al., *Proc. Natl. Acad. Sci. USA* 77:4216 (1980)); and myeloma cell lines such as Y0, NS0 and Sp2/0. For a review of certain mammalian host cell lines suitable for antigen-binding molecule production, see, e.g., Yazaki and Wu, *Methods in Molecular Biology*, Vol. 248 (B. K. C. Lo, ed., Humana Press, Totowa, NJ), pp. 255-268 (2003).

C. Assays

Antigen-binding molecules provided herein may be identified, screened for, or characterized for their physical/chemical properties and/or biological activities by various assays known in the art.

1. Binding Assays and Other Assays

In one aspect, an antigen-binding molecule in the present disclosure is tested for its antigen binding activity, e.g., by known methods such as ELISA, Western blot, etc.

2. Activity Assays

In one aspect, assays are provided for identifying antigen-binding molecules thereof having biological activity. Biological activity may include, e.g., activity of holding two antigen molecules at spatially close positions, activity of regulating interaction between two antigen molecules, activity of promoting activation of an receptor by a ligand, activity of promoting catalytic reaction of an enzyme with a substrate, promoting interaction between a cell expressing a first antigen and a cell expressing a second antigen, activity of promoting damage of a target cell by a cell with cytotoxic activity (e.g., a T cell, NK cell, monocyte, or macrophage), activity of regulating activation of two antigen molecules which are activated by association with each other, and resistance to protease cleavage. Antigen-binding molecules having such biological activity in vivo and/or in vitro are also provided.

Furthermore, an antigen-binding molecule in the present disclosure can exert various biological activities depending on the type of an antigen molecule to which the antigen-binding molecule binds. Examples of such antigen-binding molecules include an antigen-binding molecule which binds to a T cell receptor (TCR) complex (e.g., CD3) and has activity of inducing T cell activation (agonist activity); and an antigen-binding molecule which binds to a molecule of TNF receptor superfamily (e.g., OX40 or 4-1BB) or of other co-stimulatory molecules (e.g., CD28 or ICOS) and has activity of promoting the above-mentioned activation (agonist activity). In certain embodiments, such biological activity exerted through the binding to an antigen molecule is enhanced or diminished by the linking of two or more antigen-binding domains comprised in the antigen-binding molecule in the present disclosure. Without being limited by theory, in certain embodiments, such enhancement or diminishment may be achieved because the interaction between two or more antigen molecules is regulated through the binding to the antigen-binding molecule in the present disclosure (e.g., the association between two or more antigen molecules is promoted).

In certain embodiments, an antigen-binding molecule of the invention is tested for such biological activity. Whether two antigen molecules are held spatially close can be evaluated using techniques such as crystal structure analysis, electron microscopy, and electron tomography-based structural analysis of a complex composed of antigens and an antigen-binding molecule. Whether two antigen-binding domains are spatially close to each other or whether the mobility of two antigen-binding domains is reduced can also be evaluated by the above-mentioned techniques. In particular, as for techniques to analyze the three-dimensional structure of IgG molecules using electron tomography, see, for example, Zhang et al., *Sci. Rep.* 5:9803 (2015). In electron tomography, the frequency of occurrence of structures that a subject molecule may form can be shown by histograms, enabling distributional evaluation of structural changes such as reduced mobility of domains. For example, when the relationship between values that can be taken by structure-related parameters, such as distance and angle between two domains, and their frequency of occurrence is shown by histograms, one can determine that the mobility of the two domains is decreased if their areas of distribution are decreased. Activity exerted through interaction and such of two antigen molecules can be evaluated by selecting and using an appropriate activity measurement system from known ones according to the type of target antigen molecules. The effect on protease cleavage can be evaluated using methods known to those skilled in the art, or methods described in the Examples below.

D. Pharmaceutical Formulations (Pharmaceutical Compositions)

Pharmaceutical formulations of an antigen-binding molecule as described herein are prepared by mixing such antigen-binding molecule having the desired degree of purity with one or more optional pharmaceutically acceptable carriers (*Remington's Pharmaceutical Sciences* 16th edition, Osol, A. Ed. (1980)), in the form of lyophilized formulations or aqueous solutions. Pharmaceutically acceptable carriers are generally nontoxic to recipients at the dosages and concentrations employed, and include, but are not limited to: buffers such as phosphate, citrate, and other organic acids; antioxidants including ascorbic acid and methionine; preservatives (such as octadecyldimethylbenzyl ammonium chloride; hexamethonium chloride; benzalkonium chloride; benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; salt-forming counter-ions such as sodium; metal complexes (e.g. Zn-protein complexes); and/or non-ionic surfactants such as polyethylene glycol (PEG). Exemplary pharmaceutically acceptable carriers herein further include interstitial drug dispersion agents such as soluble neutral-active hyaluronidase glycoproteins (sHASEGP), for example, human soluble PH-20 hyaluronidase glycoproteins, such as rHuPH20 (HYLENEX (registered trademark), Baxter International, Inc.). Certain exemplary sHASEGPs and methods of use, including rHuPH20, are described in US Patent Publication Nos. 2005/0260186 and 2006/0104968. In one aspect, a sHASEGP is combined with one or more additional glycosaminoglycanases such as chondroitinases.

Exemplary lyophilized antigen-binding molecule formulations are described in U.S. Pat. No. 6,267,958. Aqueous antigen-binding molecule formulations include those described in U.S. Pat. No. 6,171,586 and WO2006/044908, the latter formulations including a histidine-acetate buffer.

The formulation herein may also contain more than one active ingredients as necessary for the particular indication being treated, preferably those with complementary activities that do not adversely affect each other. Such active ingredients are suitably present in combination in amounts that are effective for the purpose intended.

Active ingredients may be entrapped in microcapsules prepared, for example, by coacervation techniques or by interfacial polymerization, for example, hydroxymethylcellulose or gelatin-microcapsules and poly-(methylmethacrylate) microcapsules, respectively, in colloidal drug delivery systems (for example, liposomes, albumin microspheres, microemulsions, nano-particles and nanocapsules) or in macroemulsions. Such techniques are disclosed in Remington's Pharmaceutical Sciences 16th edition, Osol, A. Ed. (1980).

Sustained-release preparations may be prepared. Suitable examples of sustained-release preparations include semipermeable matrices of solid hydrophobic polymers containing the antigen-binding molecule, which matrices are in the form of shaped articles, e.g. films, or microcapsules.

The formulations to be used for in vivo administration are generally sterile. Sterility may be readily accomplished, e.g., by filtration through sterile filtration membranes.

EXAMPLES

The following are examples of antigen-binding molecules and methods of the present disclosure. It will be understood that various other embodiments may be practiced, given the general description provided above.

Example 1 Concept of Fab-Crosslinked Antibody

Agonist antibodies are superior in properties such as stability, pharmacokinetics, and production methods compared to natural ligands and their fusion proteins, and their pharmaceutical development is under way. However, in general, agonist antibodies with strong activity are more difficult to obtain than mere binding or neutralizing antibodies. A solution to this problem is therefore being wanted.

Properties needed for an agonist antibody may depend on the type of the ligand. For agonist antibodies against the TNF receptor superfamily, typified by Death receptor (DR), OX40, 4-1BB, CD40, and such, it has been reported that multimerization of antibody or ligand contributes to the activation. As techniques for increasing this effect, use of natural ligands, crosslinking by anti-Fc antibodies, crosslinking via FcγRs, multimerization of antibody binding domains, multimerization via antibody Fc, and such have been reported to enhance the agonist activity. It is also known that, for certain types of antigens, adjustment of the distance of antigen-binding sites using antibody Fab structure or scFv leads to enhancement of the agonist activity regardless of multimerization.

As another technique, an agonist antibody against a cytokine receptor which is a bispecific antibody capable of binding to different epitopes within the same antigen has been reported. Moreover, a method of improving agonist activity by using chemical conjugation to crosslink two different Fabs in a similar manner has been reported.

More methods besides those mentioned above for improving the activity of agonist antibodies are wanted. However, no simple method to achieve this has been reported. Thus, the inventors developed a method for crosslinking Fabs with each other through introducing minimum mutations, and demonstrated that this actually enhanced the agonist activity, thereby completing the invention. An exemplifying embodiment is shown in FIG. 1.

Example 2 Production of Expression Vectors for Modified Antibodies, and Expression and Purification of Modified Antibodies An antibody gene inserted in an expression vector for animal cells was subjected to amino acid residue sequence substitution by a method known to the person skilled in the art using PCR, the In-Fusion Advantage PCR cloning kit (TAKARA), or such, to construct an expression vector for a modified antibody. The nucleotide sequence of the resulting expression vector was determined by a method known to the person skilled in the art. The produced expression vector was transiently introduced into FreeStyle293® or Expi293® cells (Invitrogen) and the cells were allowed to express the modified antibody into culture supernatant. The modified antibody was purified from the obtained culture supernatant by a method known to the person skilled in the art using rProtein A Sepharose® Fast Flow (GE Healthcare). Absorbance at 280 nm was measured using a spectrophotometer. An absorption coefficient was calculated from the measured value using the PACE method and used to calculate the antibody concentration (Protein Science 1995; 4:2411-2423). The amount of aggregates of the modified antibody was analyzed by a method known to the person skilled in the art using Agilent 1260 Infinity® (Agilent Technologies) for HPLC and G3000SW$_{XL}$ (TOSOH) as a gel filtration chromatography column. The concentration of the purified antibody was 0.1 mg/mL, and 10 µL of the antibody was injected.

Antibodies prepared by this method (anti-CD3ε antibodies, anti-CD28 antibodies, and anti-CD3ε×anti-CD28 bispecific antibodies) are shown in Table 2.

TABLE 2

Antibody names, SEQ ID NOs

| Antibody name | SEQ ID NO: | | | |
| --- | --- | --- | --- | --- |
| | Heavy chain 1 | Light chain 1 | Heavy chain 2 | Light chain 2 |
| CD3-G4s | 1 | 10 | — | — |
| CD3-G4sHH | 2 | 10 | — | — |
| CD3-G4sLL | 1 | 11 | — | — |
| CD3-G1s | 4 | 10 | — | — |
| OKT3-G1s | 5 | 12 | — | — |
| CD28-G1 | 6 | 13 | — | — |
| CD3-G1sLL | 4 | 11 | — | — |
| CD3-G1sHH | 7 | 10 | — | — |
| CD3//CD28-G1s | 4 | 10 | 6 | 13 |
| CD3//CD28-G1sLL | 4 | 11 | 6 | 14 |
| CD3//CD28-G1sHH | 7 | 10 | 9 | 13 |
| CD3//CD28-G1sLH | 4 | 11 | 9 | 13 |
| CD3//CD28-G1sHL | 7 | 10 | 6 | 14 |
| OKT3//CD28-G1s | 5 | 12 | 6 | 13 |
| OKT3//CD28-G1sHH | 8 | 12 | 9 | 13 |
| OKT3//CD28-G1sHL | 8 | 12 | 6 | 14 |

HH: position 191 (EU numbering) was altered to Cys in the two H chain constant regions
LL: position 126 (EU numbering) was altered to Cys in the two L chain constant regions
HL, LH: position 191 (EU numbering) was altered to Cys in one H chain constant region, and position 126 (EU numbering) was altered to Cys in one L chain constant region Example 3 Preparation of Bispecific Antibodies The purified antibody was dialyzed into TBS (WAKO) buffer and its concentration was adjusted to 1 mg/mL. As a 10×reaction buffer, 250 mM 2-MEA (SIGMA) was prepared. Two different homodimeric antibodies prepared in Example 2 were mixed in equal amount. To this mixture, a 1/10 volume of the 10×reaction buffer was added and mixed. The mixture was allowed to stand at 37° C. for 90 minutes. After the reaction, the mixture was dialyzed into TBS to obtain a solution of a bispecific antibody in which the above two different antibodies were heterodimerized. The antibody concentration was measured by the above-mentioned method, and the antibody was subjected to subsequent experiments.

Example 4 Assessment of Agonist Activity

Example 4-1 Preparation of Jurkat Cell Suspension

Jurkat cells (TCR/CD3 Effector Cells (NFAT), Promega) were collected from flasks. The cells were washed with Assay Buffer (RPMI 1640 medium (Gibco), 10% FBS (HyClone), 1% MEM Non Essential Amino Acids (Invitrogen), and 1 mM Sodium Pyruvate (Invitrogen)), and then suspended at $3\times10^6$ cells/mL in Assay Buffer. This suspension of Jurkat cells was subjected to subsequent experiments.

Example 4-2 Preparation of Luminescence Reagent Solution 100 mL of Bio-Glo Luciferase Assay Buffer (Promega) was added to the bottle of Bio-Glo Luciferase Assay Substrate (Promega), and mixed by inversion. The bottle was protected from light and frozen at −20° C. This luminescence reagent solution was subjected to subsequent experiments.

Example 4-3 T Cell Activation Assay

T cell activation by agonist signaling was assessed based on the fold change of luciferase luminescence. The aforementioned Jurkat cells are cells transformed with a luciferase reporter gene having a NFAT responsive sequence. When the cells are stimulated by an anti-TCR/CD3 antibody, the NFAT pathway is activated via intracellular signaling, thereby inducing luciferase expression. The Jurkat cells suspension prepared as described above was added to a 384-well flat-bottomed white plate at 10 µL per well ($3\times10^4$ cells/well). Next, the antibody solution prepared at each concentration (150, 15, 1.5, 0.15, 0.015, 0.0015, 0.00015, 0.000015 nM) was added at 20 µL per well. This plate was allowed to stand in a 5% $CO_2$ incubator at 37° C. for 24 hours. After the incubation, the luminescence reagent solution was thawed, and 30 µL of the solution was added to each well. The plate was then allowed to stand at room temperature for 10 minutes. Luciferase luminescence in each well of the plate was measured using a luminometer.

Figure 2:
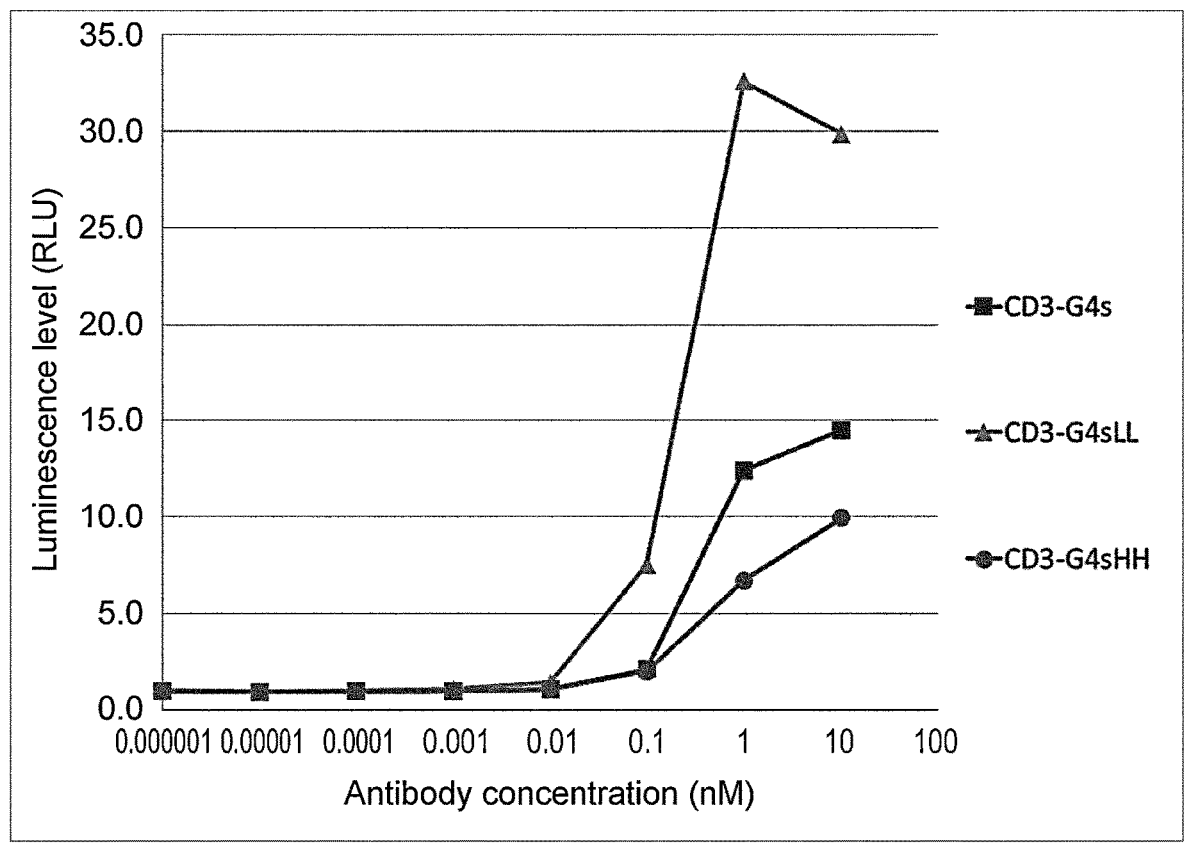
FIG. 2 shows the results of assaying the CD3-mediated agonist activity of a wild-type anti-CD3ε antibody molecule (CD3-G4s) and modified antibody molecules produced by linking the Fab-Fab of the wild-type molecule via an additional disulfide bond (CD3-G4sLL, CD3-G4sHH), as described in Example 4-3.
Figure 3:
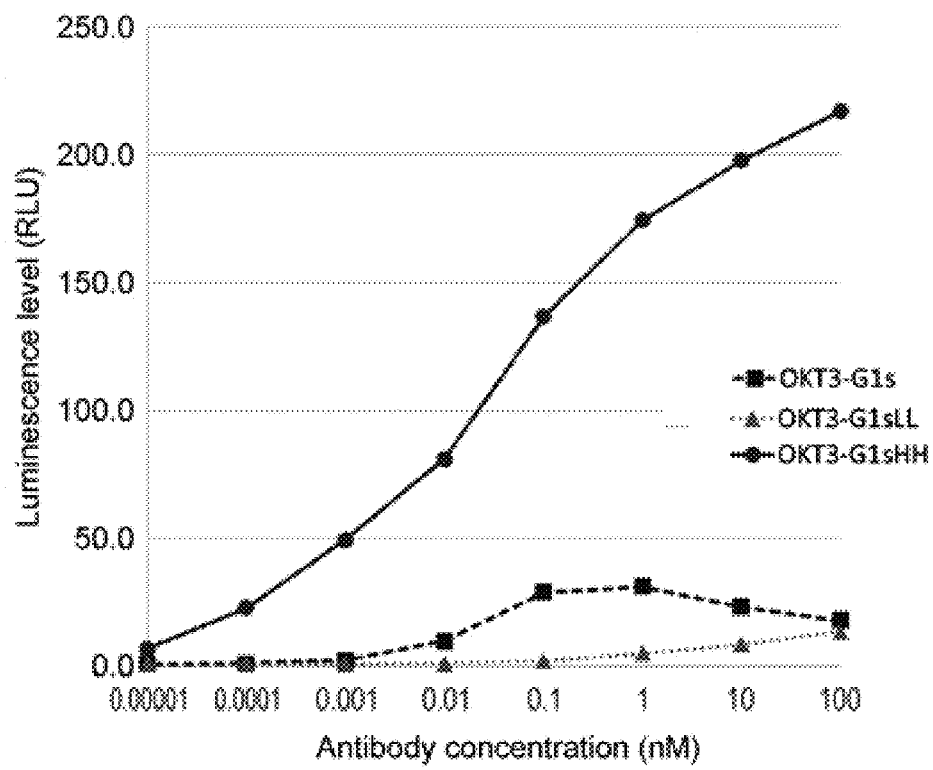
FIG. 3 shows the results of assaying the CD3-mediated agonist activity of a wild-type anti-CD3ε antibody molecule (OKT3-G1s) and modified antibody molecules produced by linking the Fab-Fab of the wild-type molecule via an additional disulfide bond (OKT3-G1sLL, OKT3-G1sHH), as described in Example 4-3.
Figure 4:
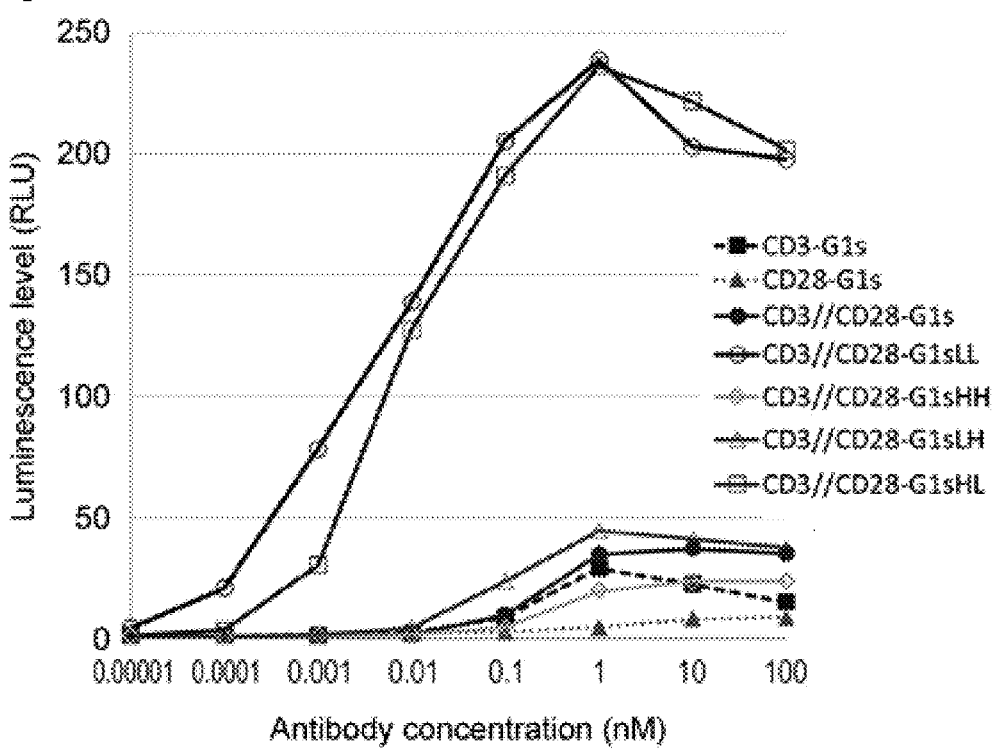
FIG. 4 shows the results of assaying the CD3- and/or CD28-mediated agonist activity of a wild-type anti-CD3ε antibody molecule (CD3-G1s), an anti-CD28 antibody molecule (CD28-G1s), and an anti-CD3ε×anti-CD28 bispecific antibody (CD3//CD28-G1s), and modified antibody molecules produced by linking the Fab-Fab of the bispecific antibody via an additional disulfide bond (CD3//CD28-G1sLL, CD3//CD28-G1sHH, CD3//CD28-G1sLH, CD3//CD28-G1sHL), as described in Example 4-3.
Figure 5:
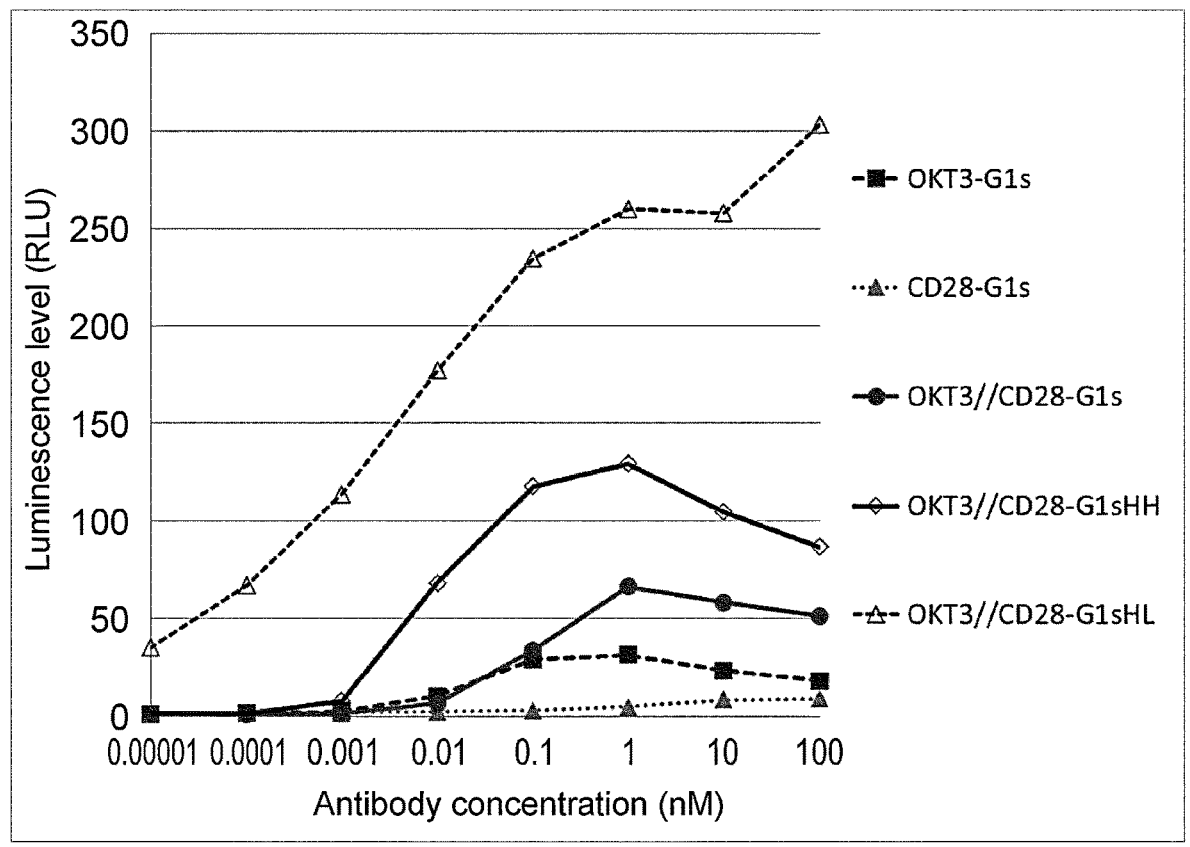
FIG. 5 shows the results of assaying the CD3- and/or CD28-mediated agonist activity of a wild-type anti-CD3ε antibody molecule (OKT3-G1s), an anti-CD28 antibody molecule (CD28-G1s), and an anti-CD3ε×anti-CD28 bispecific antibody (OKT3//CD28-G1s), and modified antibody molecules produced by linking the Fab-Fab of the bispecific antibody via an additional disulfide bond (OKT3//CD28-G1sHH, OKT3//CD28-G1sHL), as described in Example 4-3.
Figure 6:
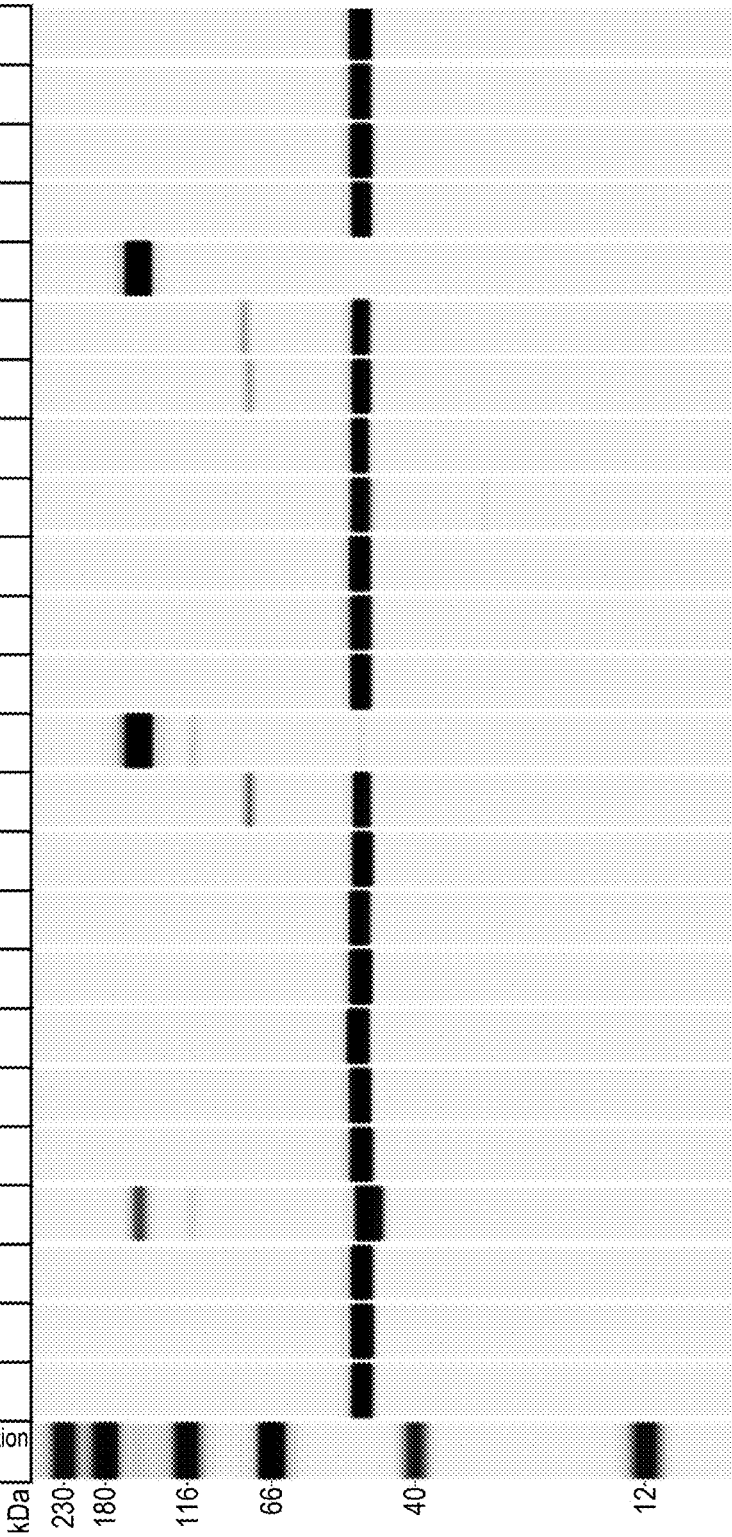
FIG. 6 shows the results of protease treatment of an anti-IL6R antibody (MRA) and modified antibodies produced by introducing a cysteine substitution into the heavy chain variable region of the anti-IL6R antibody (MRAH.xxx-G1T4) as described in Example 5-2 (1/8). Each protease-treated antibody was applied to non-reducing capillary electrophoresis, followed by band detection with an anti-kappa chain antibody.
Figure 7:
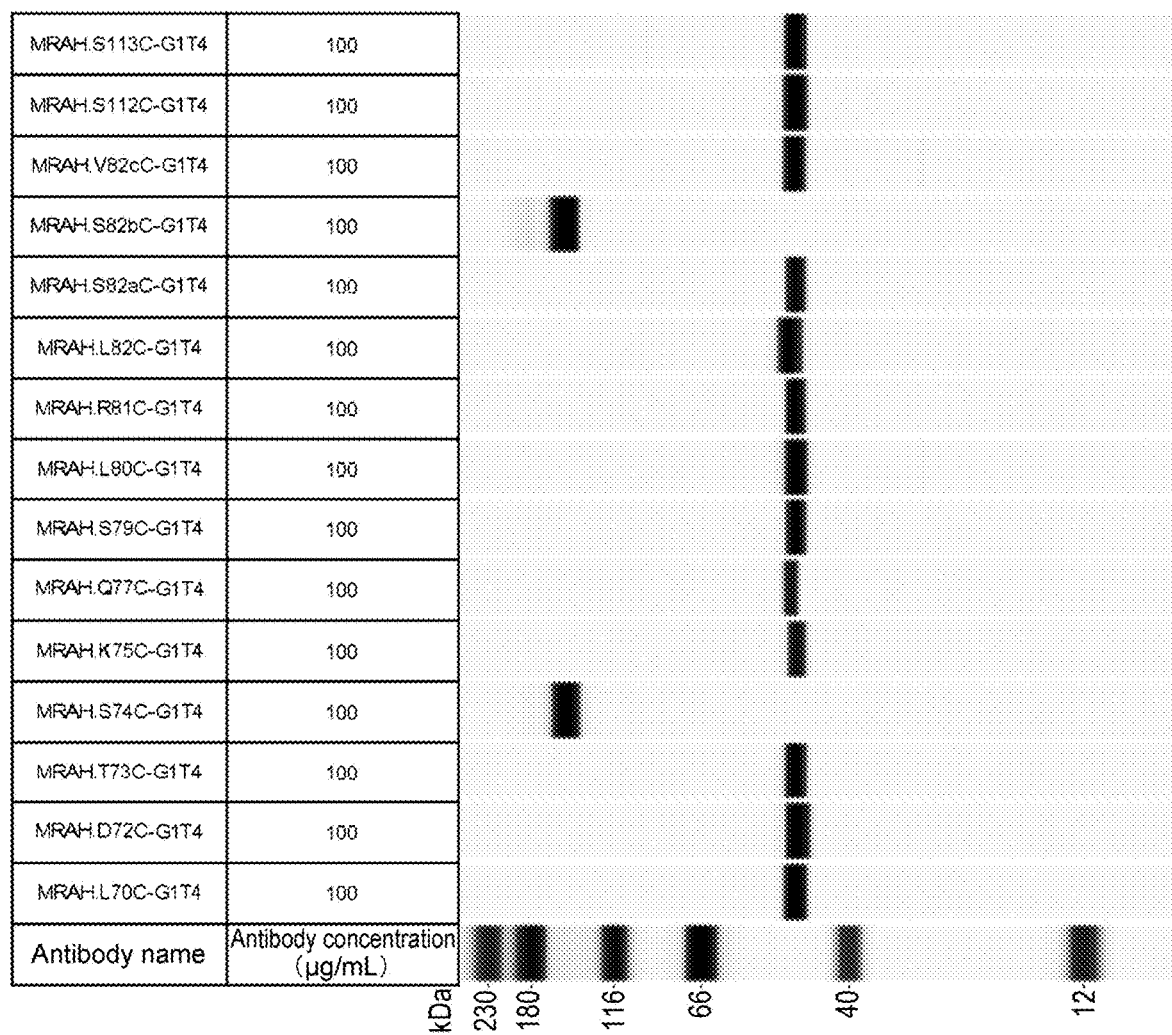
FIG. 7 shows the results of protease treatment of modified antibodies produced by introducing a cysteine substitution into the heavy chain variable region of the anti-IL6R antibody (MRAH.xxx-G1T4), as described in Example 5-2 (2/8). Each protease-treated antibody was applied to non-reducing capillary electrophoresis, followed by band detection with an anti-kappa chain antibody.
Figure 8:
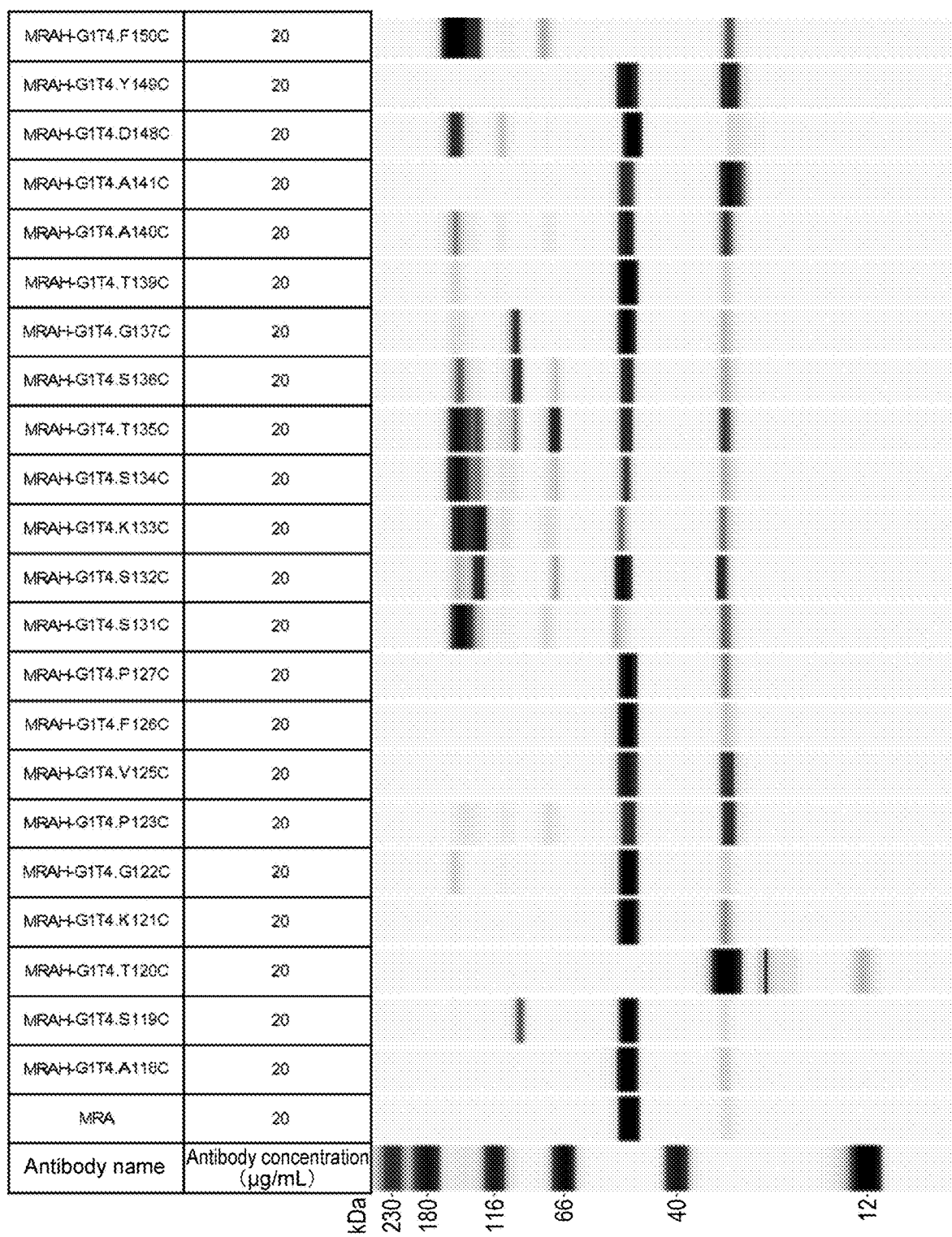
FIG. 8 shows the results of protease treatment of an anti-IL6R antibody (MRA) and modified antibodies produced by introducing a cysteine substitution into the heavy chain constant region of the anti-IL6R antibody (MRAH-G1T4.xxx), as described in Example 5-2 (3/8). Each protease-treated antibody was applied to non-reducing capillary electrophoresis, followed by band detection with an anti-kappa chain antibody.
Figure 9:
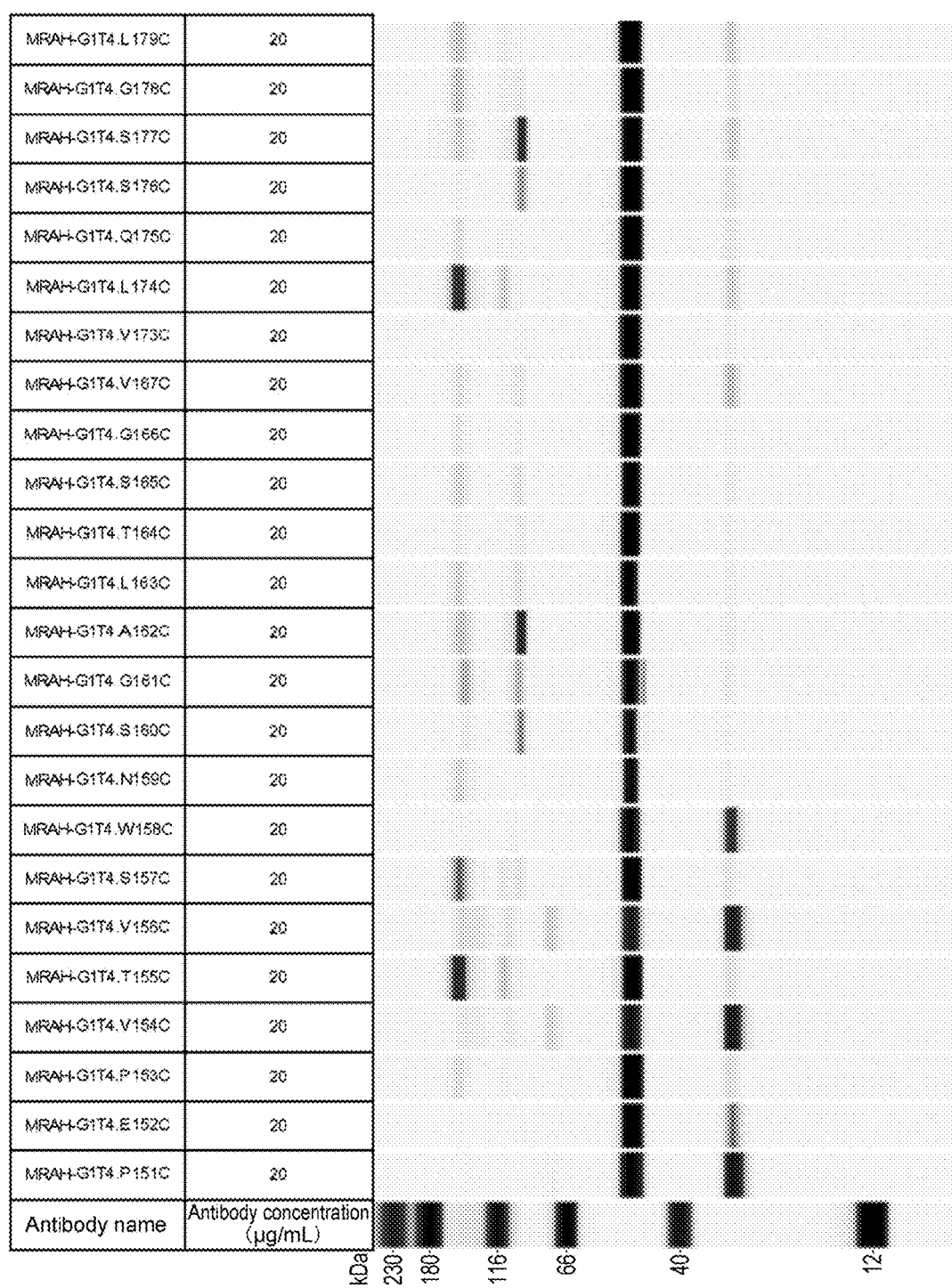
FIG. 9 shows the results of protease treatment of modified antibodies produced by introducing a cysteine substitution into the heavy chain constant region of the anti-IL6R antibody (MRAH-G1T4.xxx), as described in Example 5-2 (4/8). Each protease-treated antibody was applied to non-reducing capillary electrophoresis, followed by band detection with an anti-kappa chain antibody.
Figure 10:
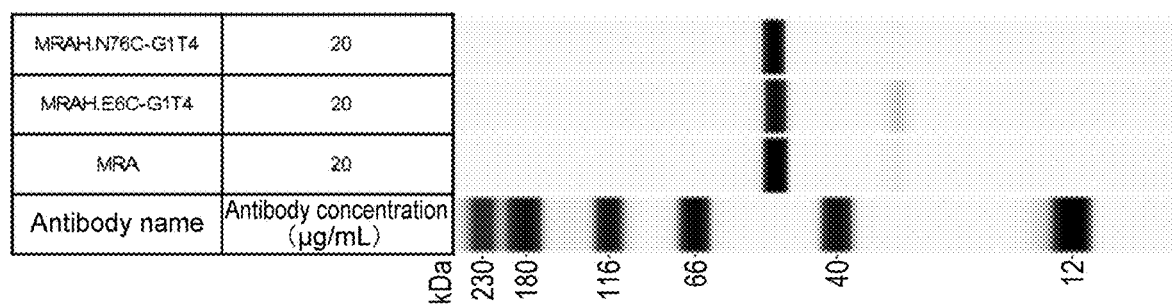
FIG. 10 shows the results of protease treatment of an anti-IL6R antibody (MRA) and modified antibodies produced by introducing a cysteine substitution into the heavy chain variable region of the anti-IL6R antibody (MRAH.xxx-G1T4), as described in Example 5-2 (5/8). Each protease-treated antibody was applied to non-reducing capillary electrophoresis, followed by band detection with an anti-kappa chain antibody.
Figure 11:
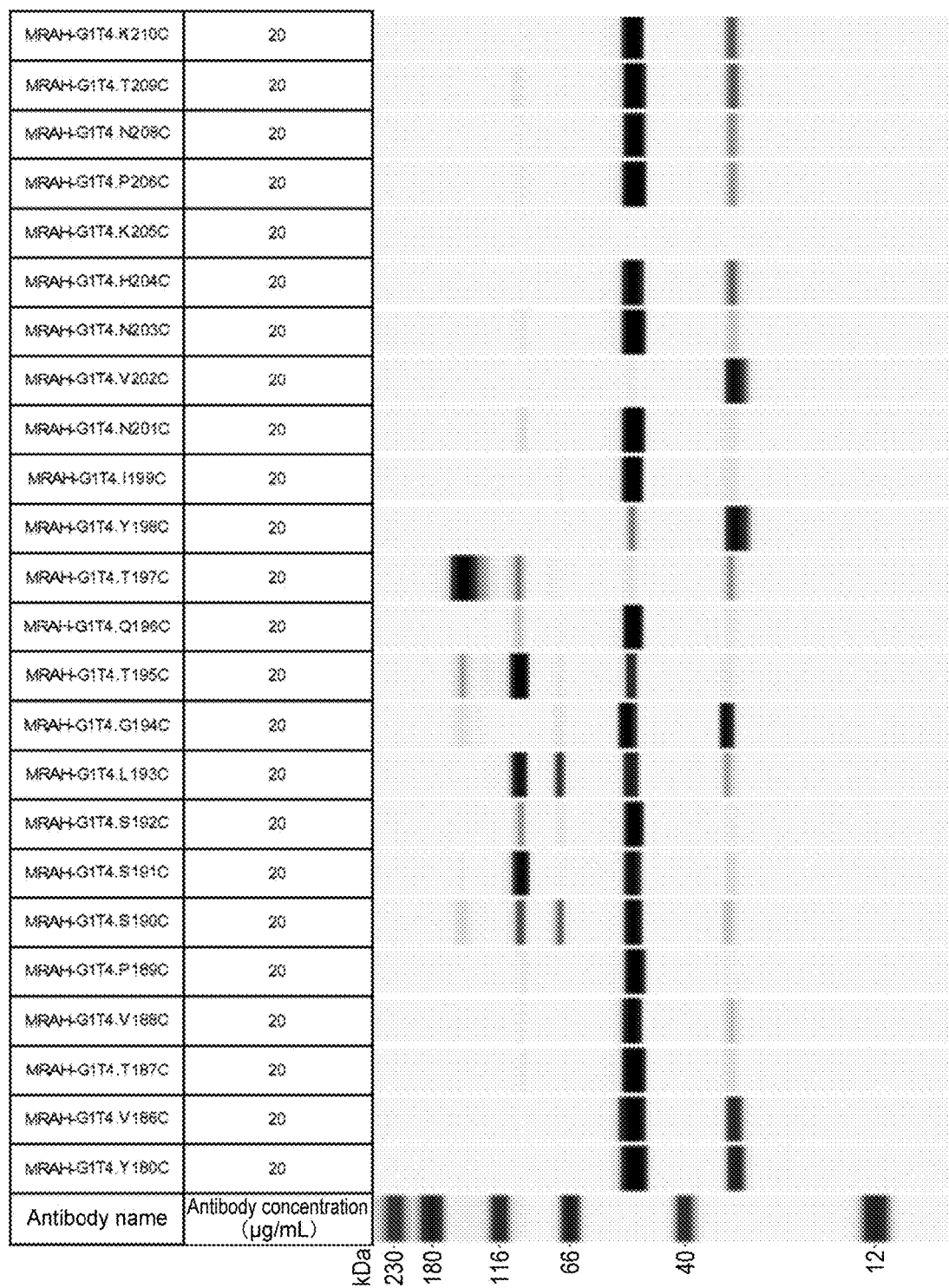
FIG. 11 shows the results of protease treatment of modified antibodies produced by introducing a cysteine substitution into the heavy chain constant region of the anti-IL6R antibody (MRAH-G1T4.xxx), as described in Example 5-2 (6/8). Each protease-treated antibody was applied to non-reducing capillary electrophoresis, followed by band detection with an anti-kappa chain antibody.
Figure 12:
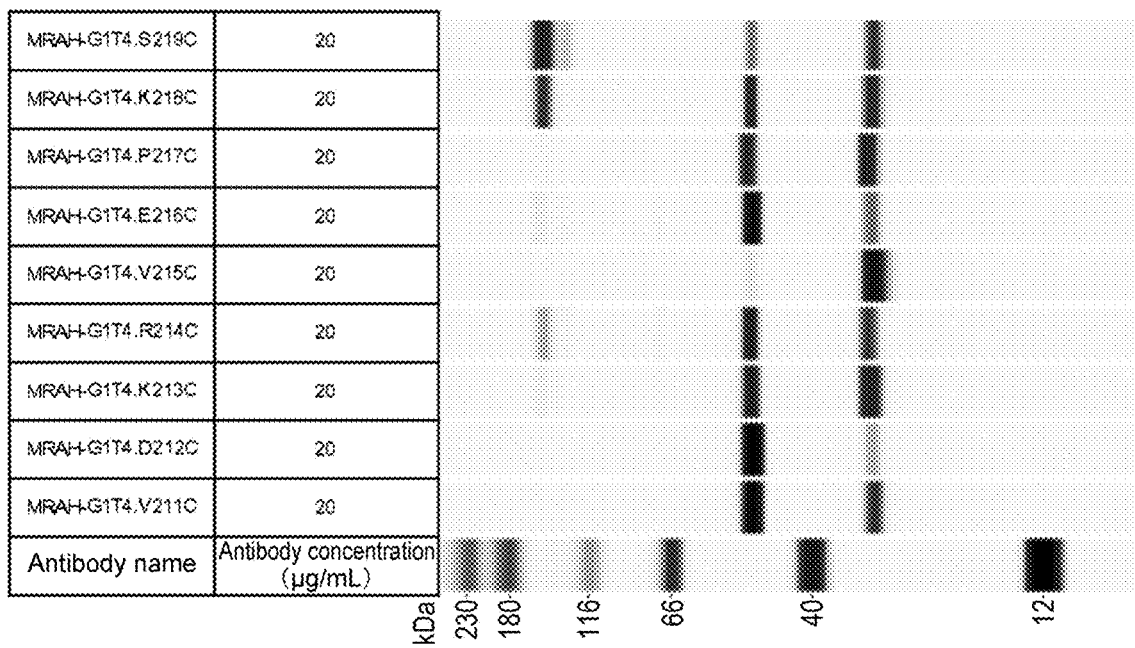
FIG. 12 shows the results of protease treatment of modified antibodies produced by introducing a cysteine substitution into the heavy chain constant region of the anti-IL6R antibody (MRAH-G1T4.xxx), as described in Example 5-2 (7/8). Each protease-treated antibody was applied to non-reducing capillary electrophoresis, followed by band detection with an anti-kappa chain antibody.
Figure 13:
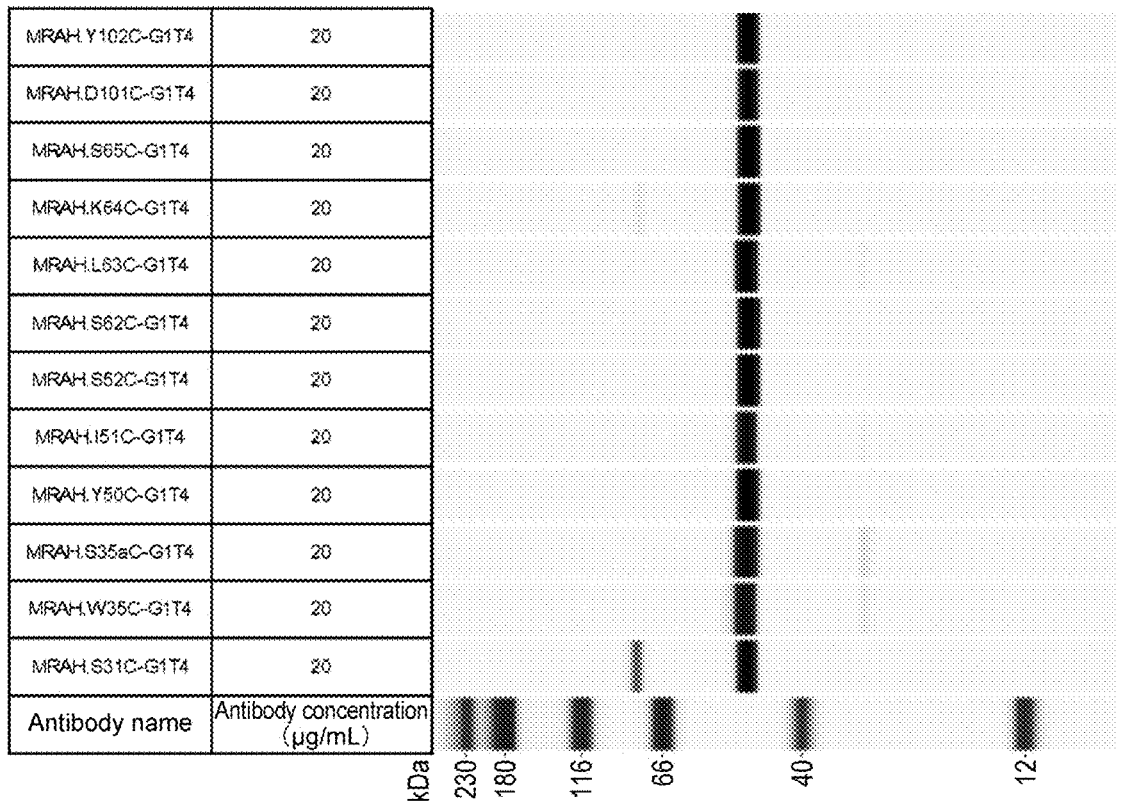
FIG. 13 shows the results of protease treatment of modified antibodies produced by introducing a cysteine substitution into the heavy chain variable region of the anti-IL6R antibody (MRAH.xxx-G1T4), as described in Example 5-2 (8/8). Each protease-treated antibody was applied to non-reducing capillary electrophoresis, followed by band detection with an anti-kappa chain antibody.
Figure 14:
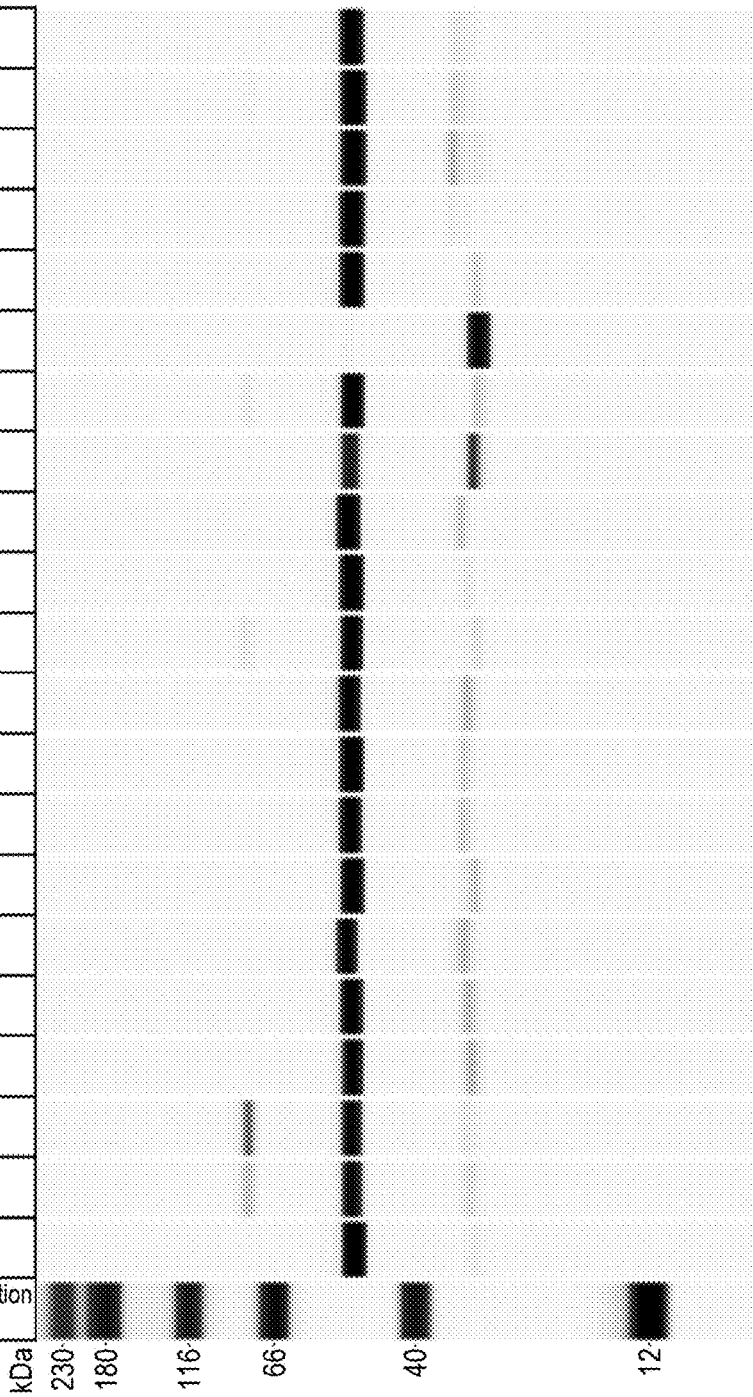
FIG. 14 shows the results of protease treatment of an anti-IL6R antibody (MRA) and modified antibodies produced by introducing a cysteine substitution into the light chain variable region of the anti-IL6R antibody (MRAL.xxx-k0), as described in Example 6-2 (1/10). Each protease-treated antibody was applied to non-reducing capillary electrophoresis, followed by band detection with an anti-kappa chain antibody.
Figure 15:
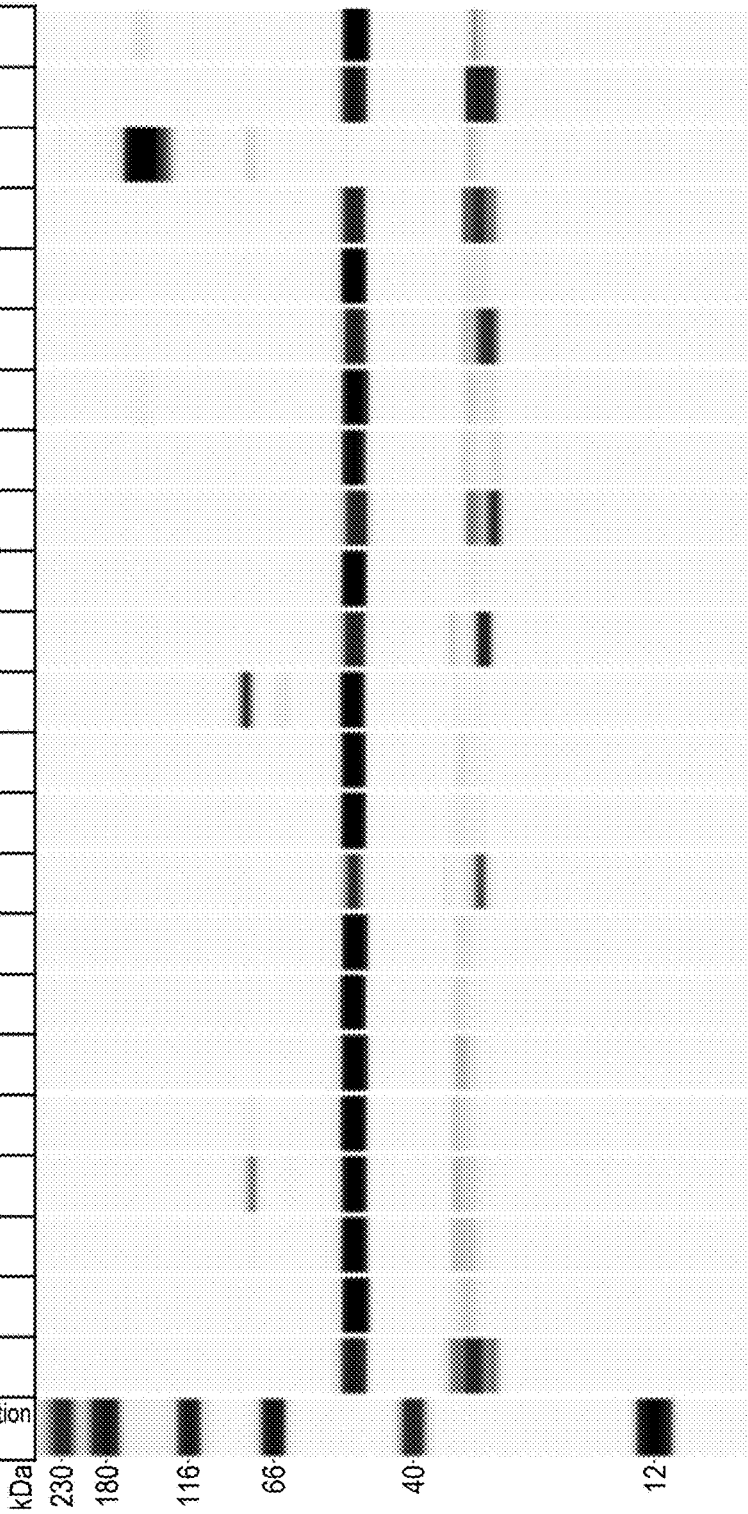
FIG. 15 shows the results of protease treatment of modified antibodies produced by introducing a cysteine substitution into the light chain variable region of the anti-IL6R antibody (MRAL.xxx-k0), as described in Example 6-2 (2/10). Each protease-treated antibody was applied to non-reducing capillary electrophoresis, followed by band detection with an anti-kappa chain antibody.
Figure 16:
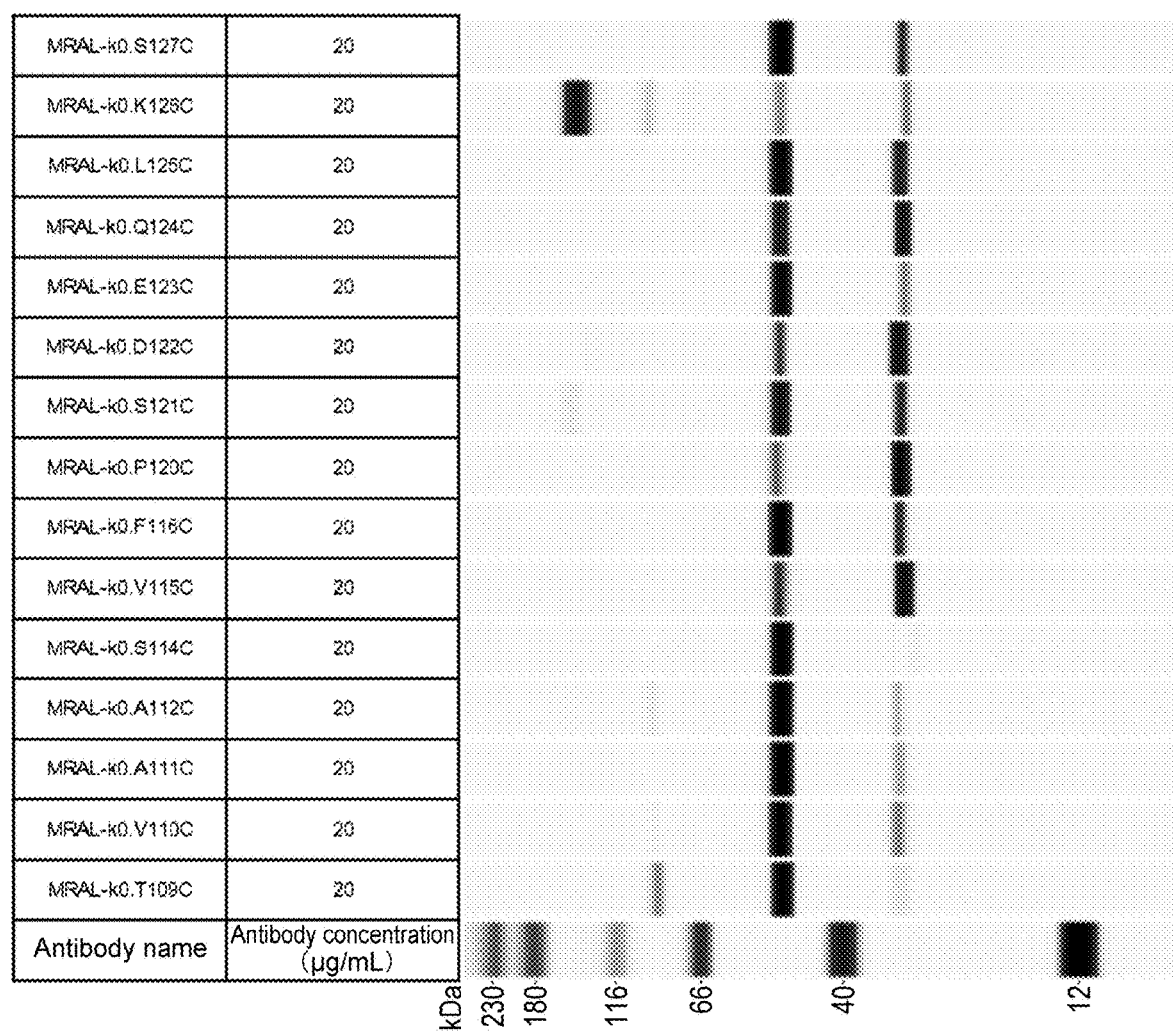
FIG. 16 shows the results of protease treatment of modified antibodies produced by introducing a cysteine substitution into the light chain constant region of the anti-IL6R antibody (MRAL-k0.xxx), as described in Example 6-2 (3/10). Each protease-treated antibody was applied to non-reducing capillary electrophoresis, followed by band detection with an anti-kappa chain antibody.
Figure 17:
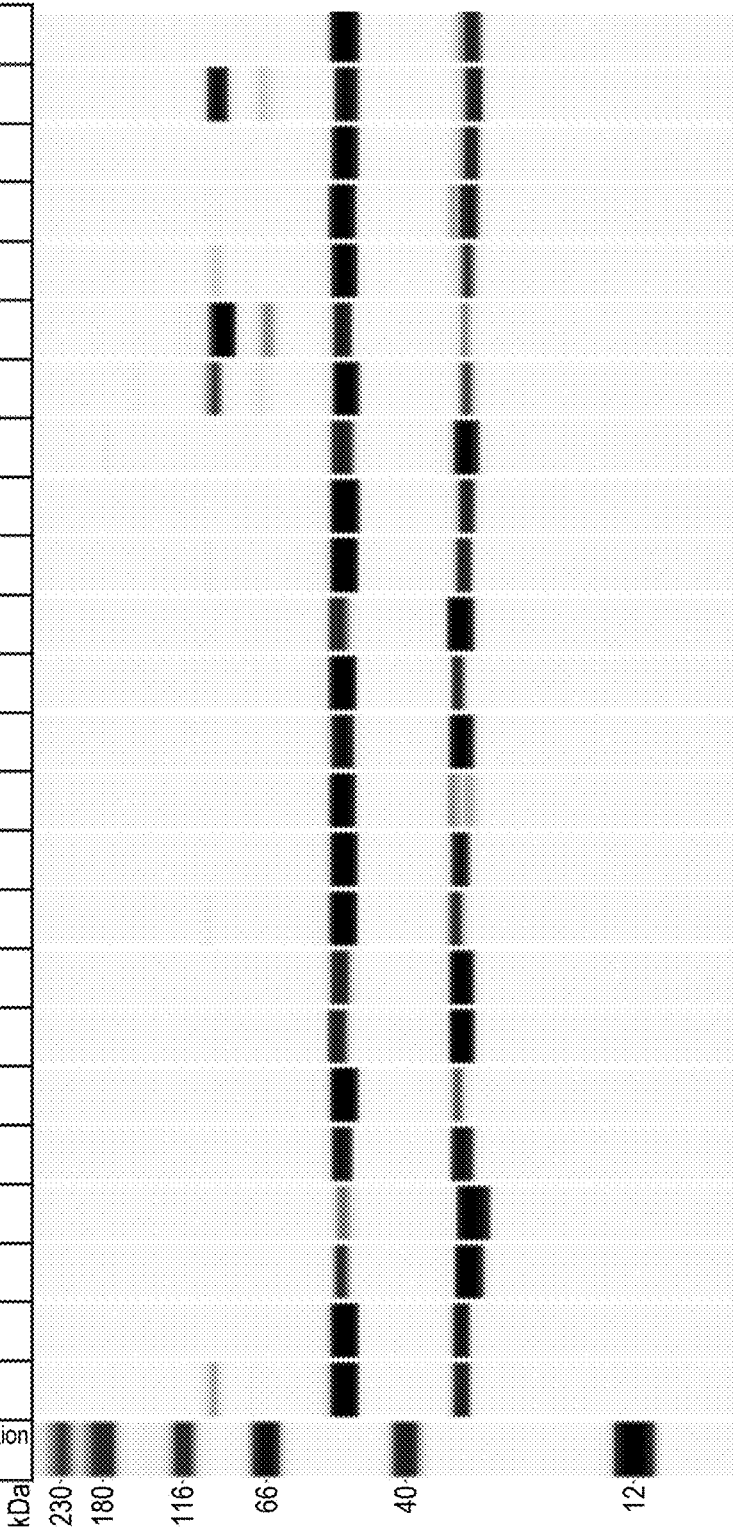
FIG. 17 shows the results of protease treatment of modified antibodies produced by introducing a cysteine substitution into the light chain constant region of the anti-IL6R antibody (MRAL-k0.xxx), as described in Example 6-2 (4/10). Each protease-treated antibody was applied to non-reducing capillary electrophoresis, followed by band detection with an anti-kappa chain antibody.
Figure 18:
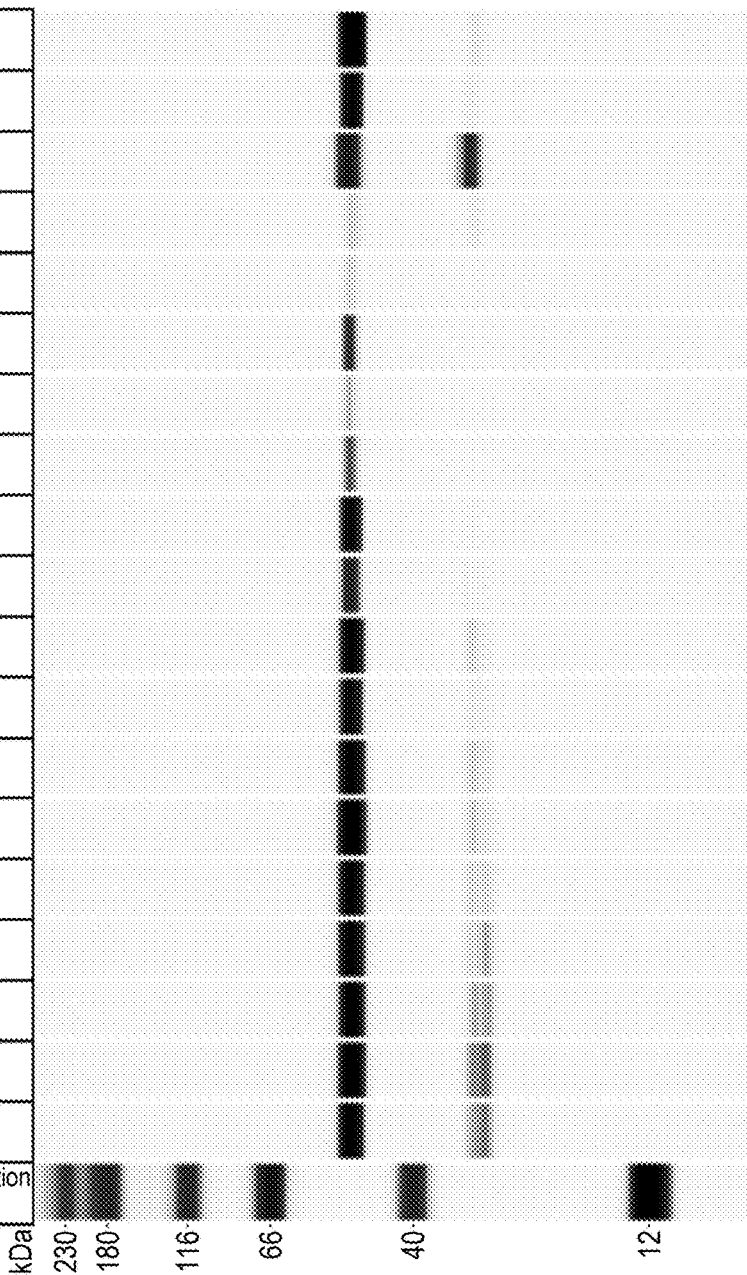
FIG. 18 shows the results of protease treatment of an anti-IL6R antibody (MRA) and modified antibodies produced by introducing a cysteine substitution into the light chain constant region of the anti-IL6R antibody (MRAL-k0.xxx), as described in Example 6-2 (5/10). Each protease-treated antibody was applied to non-reducing capillary electrophoresis, followed by band detection with an anti-kappa chain antibody.
Figure 19:
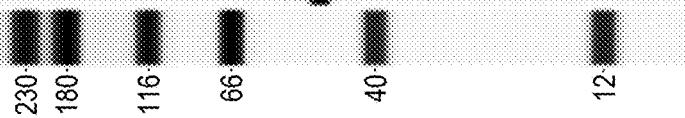
FIG. 19 shows the results of protease treatment of modified antibodies produced by introducing a cysteine substitution into the light chain constant region of the anti-IL6R antibody (MRAL-k0.xxx), as described in Example 6-2 (6/10). Each protease-treated antibody was applied to non-reducing capillary electrophoresis, followed by band detection with an anti-kappa chain antibody.
Figure 20:
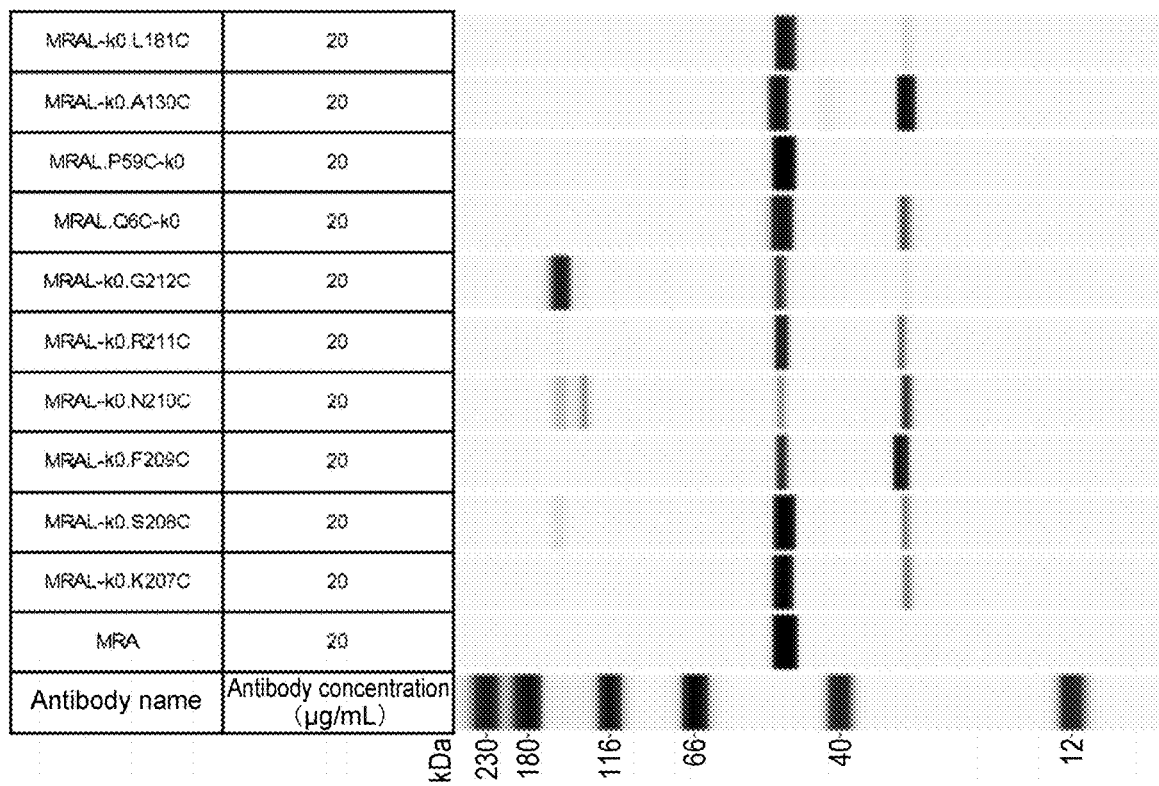
FIG. 20 shows the results of protease treatment of an anti-IL6R antibody (MRA), modified antibodies produced by introducing a cysteine substitution into the light chain variable region of the anti-IL6R antibody (MRAL.xxx-k0), and modified antibodies produced by introducing a cysteine substitution into the light chain constant region of the anti-IL6R antibody (MRAL-k0.xxx), as described in Example 6-2 (7/10). Each protease-treated antibody was applied to non-reducing capillary electrophoresis, followed by band detection with an anti-kappa chain antibody.
Figure 21:
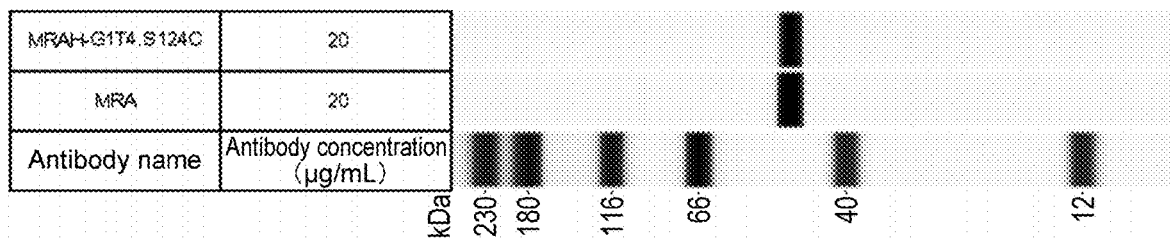
FIG. 21 shows the results of protease treatment of an anti-IL6R antibody (MRA), as described in Example 6-2 (8/10). Each protease-treated antibody was applied to non-reducing capillary electrophoresis, followed by band detection with an anti-kappa chain antibody.
Figure 22:
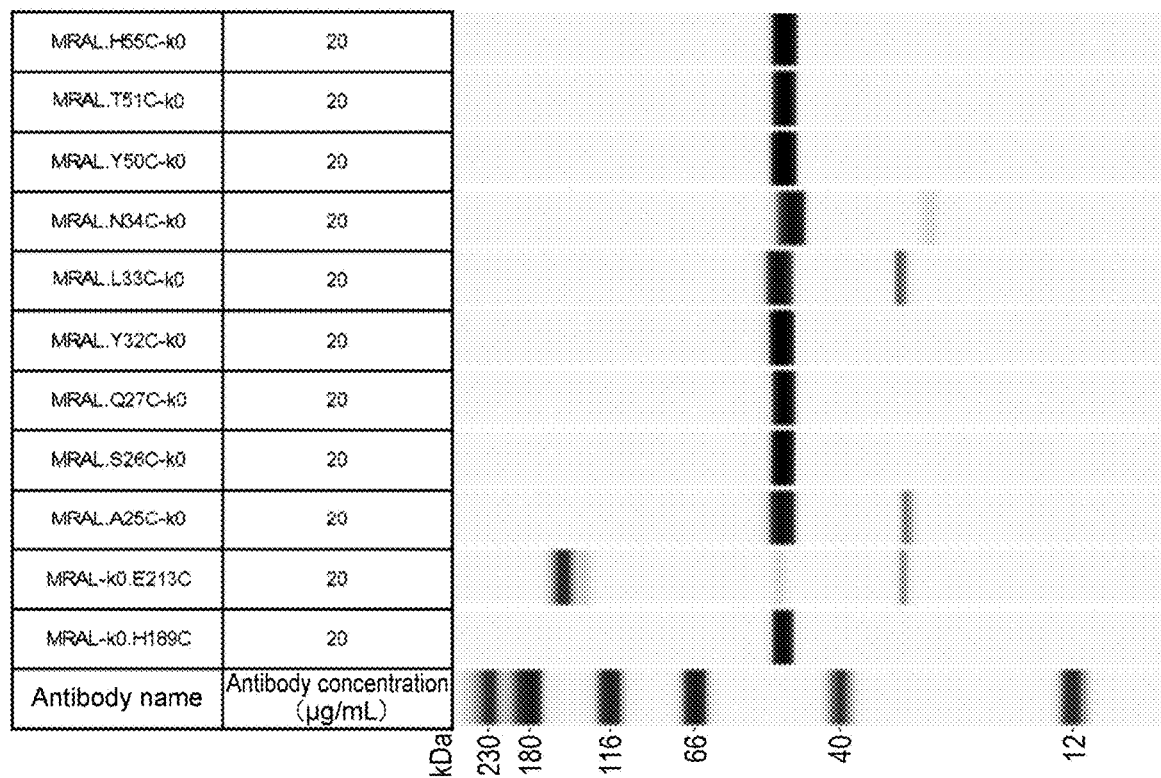
FIG. 22 shows the results of protease treatment of modified antibodies produced by introducing a cysteine substitution into the light chain variable region of the anti-IL6R antibody (MRAL.xxx-k0) and modified antibodies produced by introducing a cysteine substitution into the light chain constant region of the anti-IL6R antibody (MRAL-k0.xxx), as described in Example 6-2 (9/10). Each protease-treated antibody was applied to non-reducing capillary electrophoresis, followed by band detection with an anti-kappa chain antibody.
Figure 23:
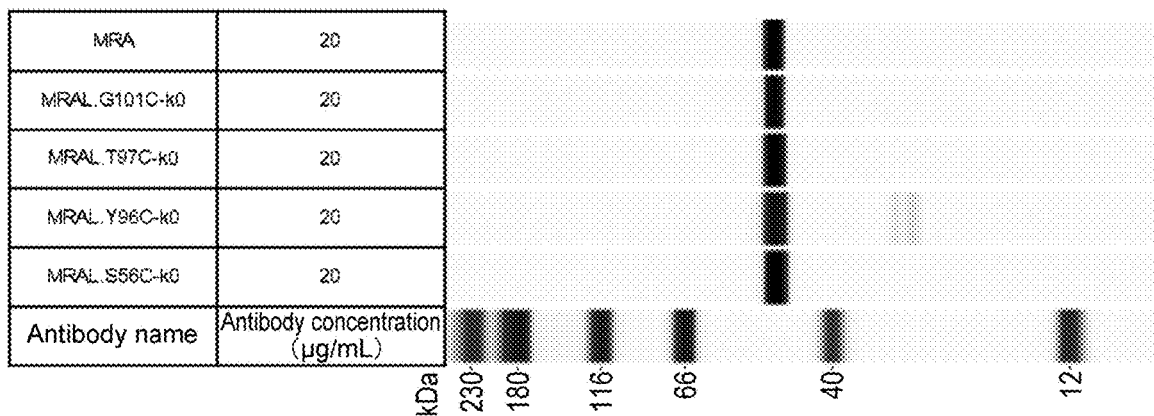
FIG. 23 shows the results of protease treatment of an anti-IL6R antibody (MRA) and modified antibodies produced by introducing a cysteine substitution into the light chain variable region of the anti-IL6R antibody (MRAL.xxx-k0), as described in Example 6-2 (10/10). Each protease-treated antibody was applied to non-reducing capillary electrophoresis, followed by band detection with an anti-kappa chain antibody.

As a result, modified molecules with an additional disulfide bond linking the Fab-Fab of anti-CD3ε antibody showed varied CD3-mediated signaling compared to the wild-type molecule (unmodified molecule) as shown in FIGS. 2 and 3. Furthermore, as shown in FIGS. 4 and 5, modified molecules of a bispecific antibody composed of an anti-CD3ε antibody and an anti-CD28 antibody with an additional disulfide bond linking the Fab-Fab also showed largely varied CD3- and/or CD28-mediated signaling compared to the wild-type molecule. These results suggest that introducing modifications of the present invention can enhance or diminish agonist activity possessed by antigen-binding molecules such as antibodies.

Example 5 Assessment of Antibodies Having Cysteine Substitution at Various Positions in the Heavy Chain Example 5-1 Assessment of Antibodies Having Cysteine Substitution at Various Positions in the Heavy Chain The heavy chain variable region and constant region of an anti-human IL6R neutralizing antibody, MRA (heavy chain: MRAH-G1T4 (SEQ ID NO: 15), light chain: MRAL-k0 (SEQ ID NO: 16)) were subjected to a study in which an arbitrary amino acid residue structurally exposed to the surface was substituted with cysteine.

Amino acid residues within the heavy chain variable region of MRA (MRAH, SEQ ID NO: 17) were substituted with cysteine to produce variants of the heavy chain variable region of MRA shown in Table 3. These variants of the heavy chain variable region of MRA were each linked with the heavy chain constant region of MRA (G1T4, SEQ ID NO: 18) to produce variants of the heavy chain of MRA, and expression vectors encoding the corresponding genes were produced by a method known to the person skilled in the art.

In addition, amino acid residues within the heavy chain constant region of MRA (G1T4, SEQ ID NO: 18) were substituted with cysteine to produce variants of the heavy chain constant region of MRA shown in Table 4. These variants of the heavy chain constant region of MRA were each linked with the heavy chain variable region of MRA (MRAH, SEQ ID NO: 17) to produce variants of the heavy chain of MRA, and expression vectors encoding the corresponding genes were produced by a method known to the person skilled in the art.

The MRA heavy chain variants produced above were combined with the MRA light chain. The resultant MRA variants shown in Table 5 were expressed by transient expression using FreeStyle293 cells (Invitrogen) or Expi293 cells (Life technologies) by a method known to the person skilled in the art, and purified with Protein A by a method known to the person skilled in the art.

TABLE 3

Variants of MRA heavy chain variable region and position of cysteine substitution

| Variant of MRA heavy chain variable region | Position of cysteine substitution (Kabat numbering) | SEQ ID NO: |
|---|---|---|
| MRAH.Q5C | 5 | 21 |
| MRAH.E6C | 6 | 22 |
| MRAH.S7C | 7 | 23 |
| MRAH.G8C | 8 | 24 |
| MRAH.P9C | 9 | 25 |
| MRAH.G10C | 10 | 26 |
| MRAH.L11C | 11 | 27 |
| MRAH.V12C | 12 | 28 |
| MRAH.R13C | 13 | 29 |
| MRAH.P14C | 14 | 30 |
| MRAH.S15C | 15 | 31 |
| MRAH.Q16C | 16 | 32 |
| MRAH.T17C | 17 | 33 |
| MRAH.L18C | 18 | 34 |
| MRAH.S19C | 19 | 35 |
| MRAH.L20C | 20 | 36 |
| MRAH.T21C | 21 | 37 |
| MRAH.T23C | 23 | 38 |
| MRAH.S25C | 25 | 39 |
| MRAH.G26C | 26 | 40 |
| MRAH.S28C | 28 | 41 |
| MRAH.T30C | 30 | 42 |
| MRAH.R66C | 66 | 43 |
| MRAH.V67C | 67 | 44 |
| MRAH.T68C | 68 | 45 |
| MRAH.L70C | 70 | 46 |
| MRAH.D72C | 72 | 47 |
| MRAH.T73C | 73 | 48 |
| MRAH.S74C | 74 | 49 |
| MRAH.K75C | 75 | 50 |
| MRAH.N76C | 76 | 51 |
| MRAH.Q77C | 77 | 52 |
| MRAH.S79C | 79 | 53 |
| MRAH.L80C | 80 | 54 |
| MRAH.R81C | 81 | 55 |
| MRAH.L82C | 82 | 56 |
| MRAH.S82aC | 82a | 57 |
| MRAH.S82bC | 82b | 58 |
| MRAH.V82cC | 82c | 59 |
| MRAH.S112C | 112 | 60 |
| MRAH.S113C | 113 | 61 |
| MRAH.S31C | 31 | 62 |
| MRAH.W35C | 35 | 63 |
| MRAH.S35aC | 35a | 64 |
| MRAH.Y50C | 50 | 65 |

TABLE 3-continued

Variants of MRA heavy chain variable region and position of cysteine substitution

| Variant of MRA heavy chain variable region | Position of cysteine substitution (Kabat numbering) | SEQ ID NO: |
|---|---|---|
| MRAH.I51C | 51 | 66 |
| MRAH.S52C | 52 | 67 |
| MRAH.S62C | 62 | 68 |
| MRAH.L63C | 63 | 69 |
| MRAH.K64C | 64 | 70 |
| MRAH.S65C | 65 | 71 |
| MRAH.D101C | 101 | 72 |
| MRAH.Y102C | 102 | 73 |

TABLE 4

Variants of MRA heavy chain constant region and position of cysteine substitution

| Variant of MRA heavy chain constant region | Position of cysteine substitution (EU numbering) | SEQ ID NO: |
|---|---|---|
| G1T4.A118C | 118 | 74 |
| G1T4.S119C | 119 | 75 |
| G1T4.T120C | 120 | 76 |
| G1T4.K121C | 121 | 77 |
| G1T4.G122C | 122 | 78 |
| G1T4.P123C | 123 | 79 |
| G1T4.S124C | 124 | 80 |
| G1T4.V125C | 125 | 81 |
| G1T4.F126C | 126 | 82 |
| G1T4.P127C | 127 | 83 |
| G1T4.S131C | 131 | 84 |
| G1T4.S132C | 132 | 85 |
| G1T4.K133C | 133 | 86 |
| G1T4.S134C | 134 | 87 |
| G1T4.T135C | 135 | 88 |
| G1T4.S136C | 136 | 89 |
| G1T4.G137C | 137 | 90 |
| G1T4.G138C | 138 | 91 |
| G1T4.T139C | 139 | 92 |
| G1T4.A140C | 140 | 93 |
| G1T4.A141C | 141 | 94 |
| G1T4.D148C | 148 | 95 |
| G1T4.Y149C | 149 | 96 |
| G1T4.F150C | 150 | 97 |
| G1T4.P151C | 151 | 98 |
| G1T4.E152C | 152 | 99 |
| G1T4.P153C | 153 | 100 |
| G1T4.V154C | 154 | 101 |
| G1T4.T155C | 155 | 102 |
| G1T4.V156C | 156 | 103 |
| G1T4.S157C | 157 | 104 |
| G1T4.W158C | 158 | 105 |
| G1T4.N159C | 159 | 106 |
| G1T4.S160C | 160 | 107 |
| G1T4.G161C | 161 | 108 |
| G1T4.A162C | 162 | 109 |
| G1T4.L163C | 163 | 110 |
| G1T4.T164C | 164 | 111 |
| G1T4.S165C | 165 | 112 |
| G1T4.G166C | 166 | 113 |
| G1T4.V167C | 167 | 114 |
| G1T4.V173C | 173 | 115 |
| G1T4.L174C | 174 | 116 |
| G1T4.Q175C | 175 | 117 |
| G1T4.S176C | 176 | 118 |
| G1T4.S177C | 177 | 119 |
| G1T4.G178C | 178 | 120 |
| G1T4.L179C | 179 | 121 |
| G1T4.Y180C | 180 | 122 |
| G1T4.V186C | 186 | 123 |
| G1T4.T187C | 187 | 124 |
| G1T4.V188C | 188 | 125 |

TABLE 4-continued

Variants of MRA heavy chain constant region and position of cysteine substitution

| Variant of MRA heavy chain constant region | Position of cysteine substitution (EU numbering) | SEQ ID NO: |
|---|---|---|
| G1T4.P189C | 189 | 126 |
| G1T4.S190C | 190 | 127 |
| G1T4.S191C | 191 | 128 |
| G1T4.S192C | 192 | 129 |
| G1T4.L193C | 193 | 130 |
| G1T4.G194C | 194 | 131 |
| G1T4.T195C | 195 | 132 |
| G1T4.Q196C | 196 | 133 |
| G1T4.T197C | 197 | 134 |
| G1T4.Y198C | 198 | 135 |
| G1T4.I199C | 199 | 136 |
| G1T4.N201C | 201 | 137 |
| G1T4.V202C | 202 | 138 |
| G1T4.N203C | 203 | 139 |
| G1T4.H204C | 204 | 140 |
| G1T4.K205C | 205 | 141 |
| G1T4.P206C | 206 | 142 |
| G1T4.S207C | 207 | 143 |
| G1T4.N208C | 208 | 144 |
| G1T4.T209C | 209 | 145 |
| G1T4.K210C | 210 | 146 |
| G1T4.V211C | 211 | 147 |
| G1T4.D212C | 212 | 148 |
| G1T4.K213C | 213 | 149 |
| G1T4.R214C | 214 | 150 |
| G1T4.V215C | 215 | 151 |
| G1T4.E216C | 216 | 152 |
| G1T4.P217C | 217 | 153 |
| G1T4.K218C | 218 | 154 |
| G1T4.S219C | 219 | 155 |

TABLE 5

MRA variants

| Antibody name | Heavy chain variable region SEQ ID NO: | Heavy chain constant region SEQ ID NO: | Light chain variable region SEQ ID NO: | Light chain constant region SEQ ID NO: |
|---|---|---|---|---|
| MRAH.Q5C-G1T4 | 21 | 18 | 19 | 20 |
| MRAH.E6C-G1T4 | 22 | 18 | 19 | 20 |
| MRAH.S7C-G1T4 | 23 | 18 | 19 | 20 |
| MRAH.G8C-G1T4 | 24 | 18 | 19 | 20 |
| MRAH.P9C-G1T4 | 25 | 18 | 19 | 20 |
| MRAH.G10C-G1T4 | 26 | 18 | 19 | 20 |
| MRAH.L11C-G1T4 | 27 | 18 | 19 | 20 |
| MRAH V12C-G1T4 | 28 | 18 | 19 | 20 |
| MRAH.R13C-G1T4 | 29 | 18 | 19 | 20 |
| MRAH.P14C-G1T4 | 30 | 18 | 19 | 20 |
| MRAH.S15C-G1T4 | 31 | 18 | 19 | 20 |
| MRAH.Q16C-G1T4 | 32 | 18 | 19 | 20 |
| MRAH.T17C-G1T4 | 33 | 18 | 19 | 20 |
| MRAH.L18C-G1T4 | 34 | 18 | 19 | 20 |
| MRAH.S19C-G1T4 | 35 | 18 | 19 | 20 |
| MRAH.L20C-G1T4 | 36 | 18 | 19 | 20 |
| MRAH.T21C-G1T4 | 37 | 18 | 19 | 20 |
| MRAH.T23C-G1T4 | 38 | 18 | 19 | 20 |
| MRAH.S25C-G1T4 | 39 | 18 | 19 | 20 |
| MRAH.G26C-G1T4 | 40 | 18 | 19 | 20 |
| MRAH.S28C-G1T4 | 41 | 18 | 19 | 20 |
| MRAH.T30C-G1T4 | 42 | 18 | 19 | 20 |
| MRAH.R66C-G1T4 | 43 | 18 | 19 | 20 |
| MRAH.V67C-G1T4 | 44 | 18 | 19 | 20 |
| MRAH.T68C-G1T4 | 45 | 18 | 19 | 20 |
| MRAH.L70C-G1T4 | 46 | 18 | 19 | 20 |
| MRAH.D72C-G1T4 | 47 | 18 | 19 | 20 |
| MRAH.T73C-G1T4 | 48 | 18 | 19 | 20 |

TABLE 5-continued

MRA variants

| Antibody name | Heavy chain variable region SEQ ID NO: | Heavy chain constant region SEQ ID NO: | Light chain variable region SEQ ID NO: | Light chain constant region SEQ ID NO: |
|---|---|---|---|---|
| MRAH.S74C-G1T4 | 49 | 18 | 19 | 20 |
| MRAH.K75C-G1T4 | 50 | 18 | 19 | 20 |
| MRAH.N76C-G1T4 | 51 | 18 | 19 | 20 |
| MRAH.Q77C-G1T4 | 52 | 18 | 19 | 20 |
| MRAH.S79C-G1T4 | 53 | 18 | 19 | 20 |
| MRAH.L80C-G1T4 | 54 | 18 | 19 | 20 |
| MRAH.R81C-G1T4 | 55 | 18 | 19 | 20 |
| MRAH.L82C-G1T4 | 56 | 18 | 19 | 20 |
| MRAH.S82aC-G1T4 | 57 | 18 | 19 | 20 |
| MRAH.S82bC-G1T4 | 58 | 18 | 19 | 20 |
| MRAH.V82cC-G1T4 | 59 | 18 | 19 | 20 |
| MRAH.S112C-G1T4 | 60 | 18 | 19 | 20 |
| MRAH.S113C-G1T4 | 61 | 18 | 19 | 20 |
| MRAH.S31C-G1T4 | 62 | 18 | 19 | 20 |
| MRAH.W35C-G1T4 | 63 | 18 | 19 | 20 |
| MRAH.S35aC-G1T4 | 64 | 18 | 19 | 20 |
| MRAH.Y50C-G1T4 | 65 | 18 | 19 | 20 |
| MRAH.I51C-G1T4 | 66 | 18 | 19 | 20 |
| MRAH.S52C-G1T4 | 67 | 18 | 19 | 20 |
| MRAH.S62C-G1T4 | 68 | 18 | 19 | 20 |
| MRAH.L63C-G1T4 | 69 | 18 | 19 | 20 |
| MRAH.K64C-G1T4 | 70 | 18 | 19 | 20 |
| MRAH.S65C-G1T4 | 71 | 18 | 19 | 20 |
| MRAH.D101C-G1T4 | 72 | 18 | 19 | 20 |
| MRAH.Y102C-G1T4 | 73 | 18 | 19 | 20 |
| MRAH-G1T4.A118C | 17 | 74 | 19 | 20 |
| MRAH-G1T4.S119C | 17 | 75 | 19 | 20 |
| MRAH-G1T4.T120C | 17 | 76 | 19 | 20 |
| MRAH-G1T4.K121C | 17 | 77 | 19 | 20 |
| MRAH-G1T4.G122C | 17 | 78 | 19 | 20 |
| MRAH-G1T4.P123C | 17 | 79 | 19 | 20 |
| MRAH-G1T4.S124C | 17 | 80 | 19 | 20 |
| MRAH-G1T4.V125C | 17 | 81 | 19 | 20 |
| MRAH-G1T4.F126C | 17 | 82 | 19 | 20 |
| MRAH-G1T4.P127C | 17 | 83 | 19 | 20 |
| MRAH-G1T4.S131C | 17 | 84 | 19 | 20 |
| MRAH-G1T4.S132C | 17 | 85 | 19 | 20 |
| MRAH-G1T4.K133C | 17 | 86 | 19 | 20 |
| MRAH-G1T4.S134C | 17 | 87 | 19 | 20 |
| MRAH-G1T4.T135C | 17 | 88 | 19 | 20 |
| MRAH-G1T4.S136C | 17 | 89 | 19 | 20 |
| MRAH-G1T4.G137C | 17 | 90 | 19 | 20 |
| MRAH-G1T4.G138C | 17 | 91 | 19 | 20 |
| MRAH-G1T4.T139C | 17 | 92 | 19 | 20 |
| MRAH-G1T4.A140C | 17 | 93 | 19 | 20 |
| MRAH-G1T4.A141C | 17 | 94 | 19 | 20 |
| MRAH-G1T4.D148C | 17 | 95 | 19 | 20 |
| MRAH-G1T4.Y149C | 17 | 96 | 19 | 20 |
| MRAH-G1T4.F150C | 17 | 97 | 19 | 20 |
| MRAH-G1T4.P151C | 17 | 98 | 19 | 20 |
| MRAH-G1T4.E152C | 17 | 99 | 19 | 20 |
| MRAH-G1T4.P153C | 17 | 100 | 19 | 20 |
| MRAH-G1T4.V154C | 17 | 101 | 19 | 20 |
| MRAH-G1T4.T155C | 17 | 102 | 19 | 20 |
| MRAH-G1T4.V156C | 17 | 103 | 19 | 20 |
| MRAH-G1T4.S157C | 17 | 104 | 19 | 20 |
| MRAH-G1T4.W158C | 17 | 105 | 19 | 20 |
| MRAH-G1T4.N159C | 17 | 106 | 19 | 20 |
| MRAH-G1T4.S160C | 17 | 107 | 19 | 20 |
| MRAH-G1T4.G161C | 17 | 108 | 19 | 20 |
| MRAH-G1T4.A162C | 17 | 109 | 19 | 20 |
| MRAH-G1T4.L163C | 17 | 110 | 19 | 20 |
| MRAH-G1T4.T164C | 17 | 111 | 19 | 20 |
| MRAH-G1T4.S165C | 17 | 112 | 19 | 20 |
| MRAH-G1T4.G166C | 17 | 113 | 19 | 20 |
| MRAH-G1T4.V167C | 17 | 114 | 19 | 20 |
| MRAH-G1T4.V173C | 17 | 115 | 19 | 20 |
| MRAH-G1T4.L174C | 17 | 116 | 19 | 20 |
| MRAH-G1T4.Q175C | 17 | 117 | 19 | 20 |
| MRAH-G1T4.S176C | 17 | 118 | 19 | 20 |
| MRAH-G1T4.S177C | 17 | 119 | 19 | 20 |

TABLE 5-continued

MRA variants

| Antibody name | SEQ ID NO: | | | |
|---|---|---|---|---|
| | Heavy chain variable region | Heavy chain constant region | Light chain variable region | Light chain constant region |
| MRAH-G1T4.G178C | 17 | 120 | 19 | 20 |
| MRAH-G1T4.L179C | 17 | 121 | 19 | 20 |
| MRAH-G1T4.Y180C | 17 | 122 | 19 | 20 |
| MRAH-G1T4.V186C | 17 | 123 | 19 | 20 |
| MRAH-G1T4.T187C | 17 | 124 | 19 | 20 |
| MRAH-G1T4.V188C | 17 | 125 | 19 | 20 |
| MRAH-G1T4.P189C | 17 | 126 | 19 | 20 |
| MRAH-G1T4.S190C | 17 | 127 | 19 | 20 |
| MRAH-G1T4.S191C | 17 | 128 | 19 | 20 |
| MRAH-G1T4.S192C | 17 | 129 | 19 | 20 |
| MRAH-G1T4.L193C | 17 | 130 | 19 | 20 |
| MRAH-G1T4.G194C | 17 | 131 | 19 | 20 |
| MRAH-G1T4.T195C | 17 | 132 | 19 | 20 |
| MRAH-G1T4.Q196C | 17 | 133 | 19 | 20 |
| MRAH-G1T4.T197C | 17 | 134 | 19 | 20 |
| MRAH-G1T4.Y198C | 17 | 135 | 19 | 20 |
| MRAH-G1T4.I199C | 17 | 136 | 19 | 20 |
| MRAH-G1T4.N201C | 17 | 137 | 19 | 20 |
| MRAH-G1T4.V202C | 17 | 138 | 19 | 20 |
| MRAH-G1T4.N203C | 17 | 139 | 19 | 20 |
| MRAH-G1T4.H204C | 17 | 140 | 19 | 20 |
| MRAH-G1T4.K205C | 17 | 141 | 19 | 20 |
| MRAH-G1T4.P206C | 17 | 142 | 19 | 20 |
| MRAH-G1T4.S207C | 17 | 143 | 19 | 20 |
| MRAH-G1T4.N208C | 17 | 144 | 19 | 20 |
| MRAH-G1T4.T209C | 17 | 145 | 19 | 20 |
| MRAH-G1T4.K210C | 17 | 146 | 19 | 20 |
| MRAH-G1T4.V211C | 17 | 147 | 19 | 20 |
| MRAH-G1T4.D212C | 17 | 148 | 19 | 20 |
| MRAH-G1T4.K213C | 17 | 149 | 19 | 20 |
| MRAH-G1T4.R214C | 17 | 150 | 19 | 20 |
| MRAH-G1T4.V215C | 17 | 151 | 19 | 20 |
| MRAH-G1T4.E216C | 17 | 152 | 19 | 20 |
| MRAH-G1T4.P217C | 17 | 153 | 19 | 20 |
| MRAH-G1T4.K218C | 17 | 154 | 19 | 20 |
| MRAH-G1T4.S219C | 17 | 155 | 19 | 20 |

Example 5-2 Assessment of Protease-Mediated Fab Fragmentation of Antibodies Having Cysteine Substitution at Various Positions in the Heavy Chain Using a protease that cleaves the heavy chain hinge region of antibody to cause Fab fragmentation, the MRA variants produced in Example 5-1 were examined for whether they acquired protease resistance so that their fragmentation would be inhibited. The protease used was Lys-C(Endoproteinase Lys-C Sequencing Grade) (SIGMA; 11047825001). Reaction was performed under the conditions of 2 ng/μL protease, 100 μg/mL antibody, 80% 25 mM Tris-HCl pH 8.0, 20% PBS, and 35° C. for two hours, or under the conditions of 2 ng/μL protease, 20 μg/mL antibody, 80% 25 mM Tris-HCl pH 8.0, 20% PBS, and 35° C. for one hour. The sample was then subjected to non-reducing capillary electrophoresis. Wes (Protein Simple) was used for capillary electrophoresis, and an HRP-labeled anti-kappa chain antibody (abcam; ab46527) was used for detection. The results are shown in FIGS. 6 to 13. Lys-C treatment of MRA caused cleavage of the heavy chain hinge region, resulting in disappearance of the band of IgG at around 150 kDa and appearance of the band of Fab at around 50 kDa. For the MRA variants produced in Example 5-1, some showed the band of Fab dimer appearing at around 96 kDa and some showed the band of undigested IgG detected at around 150 kDa after the protease treatment. The area of each band obtained after the protease treatment was outputted using software dedicated for Wes (Compass for SW; Protein Simple) to calculate the percentage of the band areas of undigested IgG, Fab dimer, etc. The calculated percentage of each band is shown in Table 6.

TABLE 6

| Antibody name | IgG (%) | Fab-Fab (%) | Fab (%) | Heavy chain SEQ ID NO: | Light chain SEQ ID NO: |
|---|---|---|---|---|---|
| MRAH.Q5C-G1T4 | 0.2 | 1.5 | 97.6 | 21 | 16 |
| MRAH.E6C-G1T4 | 0 | 0.3 | 80.7 | 22 | 16 |
| MRAH.S7C-G1T4 | 0.4 | 1.9 | 96.9 | 23 | 16 |
| MRAH.G8C-G1T4 | 16.6 | 1.1 | 76.7 | 24 | 16 |
| MRAH.P9C-G1T4 | 0.2 | 1.5 | 97.2 | 25 | 16 |
| MRAH.G10C-G1T4 | 0.6 | 1.9 | 96.9 | 26 | 16 |
| MRAH.L11C-G1T4 | 0 | 1.2 | 98.3 | 27 | 16 |
| MRAH.V12C-G1T4 | 0.2 | 1 | 97.6 | 28 | 16 |
| MRAH.R13C-G1T4 | 0.6 | 1.9 | 96.6 | 29 | 16 |
| MRAH.P14C-G1T4 | 0.3 | 1.7 | 97.7 | 30 | 16 |
| MRAH.S15C-G1T4 | 0.9 | 1.3 | 81.4 | 31 | 16 |
| MRAH.Q16C-G1T4 | 92.5 | 0 | 2 | 32 | 16 |
| MRAH.T17C-G1T4 | 0.4 | 1.4 | 97.8 | 33 | 16 |
| MRAH.L18C-G1T4 | 0.3 | 0.6 | 96.1 | 34 | 16 |
| MRAH.S19C-G1T4 | 0.3 | 1.2 | 98.1 | 35 | 16 |
| MRAH.L20C-G1T4 | 1 | 0.3 | 93.3 | 36 | 16 |
| MRAH.T21C-G1T4 | 0.5 | 1 | 98.3 | 37 | 16 |
| MRAH.T23C-G1T4 | no data | no data | no data | 38 | 16 |
| MRAH.S25C-G1T4 | 0.3 | 2.8 | 87 | 39 | 16 |
| MRAH.G26C-G1T4 | 0.4 | 1.7 | 85.5 | 40 | 16 |
| MRAH.S28C-G1T4 | 98.6 | 0 | 0.2 | 41 | 16 |
| MRAH.T30C-G1T4 | 0.5 | 0.7 | 97.8 | 42 | 16 |
| MRAH.R66C-G1T4 | 0.2 | 1.2 | 97.9 | 43 | 16 |
| MRAH.V67C-G1T4 | 0.3 | 0.4 | 97.8 | 44 | 16 |
| MRAH.T68C-G1T4 | 0.2 | 1.4 | 97.7 | 45 | 16 |
| MRAH.L70C-G1T4 | 0.2 | 0.9 | 98 | 46 | 16 |
| MRAH.D72C-G1T4 | 0.3 | 0.8 | 97.6 | 47 | 16 |
| MRAH.T73C-G1T4 | 0.5 | 0.9 | 97.7 | 48 | 16 |
| MRAH.S74C-G1T4 | 97.1 | 0 | 0.3 | 49 | 16 |
| MRAH.K75C-G1T4 | 0.1 | 1.5 | 97 | 50 | 16 |
| MRAH.N76C-G1T4 | 0.4 | 0.4 | 93.1 | 51 | 16 |
| MRAH.Q77C-G1T4 | 0.1 | 0.2 | 99.6 | 52 | 16 |
| MRAH.S79C-G1T4 | 0.1 | 1.6 | 96.7 | 53 | 16 |
| MRAH.L80C-G1T4 | 0.2 | 0 | 96.5 | 54 | 16 |
| MRAH.R81C-G1T4 | 0 | 1.4 | 98 | 55 | 16 |
| MRAH.L82C-G1T4 | 0 | 0 | 96.8 | 56 | 16 |
| MRAH.S82aC-G1T4 | 0.6 | 1 | 96.7 | 57 | 16 |
| MRAH.S82bC-G1T4 | 97.5 | 0 | 0.3 | 58 | 16 |
| MRAH.V82cC-G1T4 | 0.1 | 0.3 | 95.6 | 59 | 16 |
| MRAH.S112C-G1T4 | 0.1 | 1.1 | 97.6 | 60 | 16 |
| MRAH.S113C-G1T4 | 0.1 | 2.8 | 95.9 | 61 | 16 |
| MRAH.S31C-G1T4 | 0.5 | 2 | 75.7 | 62 | 16 |
| MRAH.W35C-G1T4 | 0.1 | 0.3 | 91.1 | 63 | 16 |
| MRAH.S35aC-G1T4 | 0 | 0.6 | 90.7 | 64 | 16 |
| MRAH.Y50C-G1T4 | 0.2 | 1.5 | 95.8 | 65 | 16 |
| MRAH.I51C-G1T4 | 0.2 | 0.8 | 94.4 | 66 | 16 |
| MRAH.S52C-G1T4 | 0.3 | 1.7 | 96.4 | 67 | 16 |
| MRAH.S62C-G1T4 | 0.2 | 1.1 | 97.6 | 68 | 16 |
| MRAH.L63C-G1T4 | 0.4 | 1.4 | 94.2 | 69 | 16 |
| MRAH.K64C-G1T4 | 0 | 1.6 | 91.7 | 70 | 16 |
| MRAH.S65C-G1T4 | 0.3 | 1.7 | 95.6 | 71 | 16 |
| MRAH.D101C-G1T4 | 0 | 1.2 | 97 | 72 | 16 |
| MRAH.Y102C-G1T4 | 0.2 | 1.3 | 96.8 | 73 | 16 |
| MRAH-G1T4.A118C | 1.2 | 1 | 89 | 74 | 16 |
| MRAH-G1T4.S119C | 2.3 | 14 | 77.7 | 75 | 16 |
| MRAH-G1T4.T120C | 0 | 0.1 | 0.1 | 76 | 16 |
| MRAH-G1T4.K121C | 2.4 | 1.1 | 82.2 | 77 | 16 |
| MRAH-G1T4.G122C | 8 | 1.4 | 79.8 | 78 | 16 |
| MRAH-G1T4.P123C | 7.1 | 0 | 45.7 | 79 | 16 |
| MRAH-G1T4.S124C | 0.8 | 1.7 | 94.5 | 80 | 16 |
| MRAH-G1T4.V125C | 2.3 | 0 | 62 | 81 | 16 |
| MRAH-G1T4.F126C | 2.1 | 1 | 85.5 | 82 | 16 |
| MRAH-G1T4.P127C | 2.9 | 1.4 | 77.4 | 83 | 16 |
| MRAH-G1T4.S131C | 68.4 | 0 | 0 | 84 | 16 |
| MRAH-G1T4.S132C | 13.9 | 0.8 | 54.6 | 85 | 16 |

TABLE 6-continued

| Antibody name | IgG (%) | Fab-Fab (%) | Fab (%) | Heavy chain SEQ ID NO: | Light chain SEQ ID NO: |
|---|---|---|---|---|---|
| MRAH-G1T4.K133C | 66.8 | 0 | 0 | 86 | 16 |
| MRAH-G1T4.S134C | 63.5 | 0 | 21.9 | 87 | 16 |
| MRAH-G1T4.T135C | 44.7 | 13.2 | 23.6 | 88 | 16 |
| MRAH-G1T4.S136C | 22.9 | 27.3 | 35.1 | 89 | 16 |
| MRAH-G1T4.G137C | 8.4 | 18.1 | 62.1 | 90 | 16 |
| MRAH-G1T4.G138C | no data | no data | no data | 91 | 16 |
| MRAH-G1T4.T139C | 7.4 | 1.4 | 82.1 | 92 | 16 |
| MRAH-G1T4.A140C | 20.2 | 0 | 47.2 | 93 | 16 |
| MRAH-G1T4.A141C | 0.3 | 0 | 31.9 | 94 | 16 |
| MRAH-G1T4.D148C | 21 | 0 | 64.8 | 95 | 16 |
| MRAH-G1T4.Y149C | 0.5 | 0 | 58.1 | 96 | 16 |
| MRAH-G1T4.F150C | 79.2 | 0 | 0.4 | 97 | 16 |
| MRAH-G1T4.P151C | 2 | 0 | 56.1 | 98 | 16 |
| MRAH-G1T4.E152C | 0.9 | 0.3 | 84.8 | 99 | 16 |
| MRAH-G1T4.P153C | 4.4 | 0.8 | 86.6 | 100 | 16 |
| MRAH-G1T4.V154C | 4 | 0 | 45.7 | 101 | 16 |
| MRAH-G1T4.T155C | 20.2 | 1.4 | 67.6 | 102 | 16 |
| MRAH-G1T4.V156C | 7 | 0 | 39.2 | 103 | 16 |
| MRAH-G1T4.S157C | 13.5 | 3.2 | 75.9 | 104 | 16 |
| MRAH-G1T4.W158C | 4.2 | 0 | 66.1 | 105 | 16 |
| MRAH-G1T4.N159C | 13.9 | 1.9 | 76.1 | 106 | 16 |
| MRAH-G1T4.S160C | 7.7 | 20.9 | 66.2 | 107 | 16 |
| MRAH-G1T4.G161C | 14.1 | 12 | 68.6 | 108 | 16 |
| MRAH-G1T4.A162C | 9.6 | 17.9 | 65.8 | 109 | 16 |
| MRAH-G1T4.L163C | 10.2 | 6.1 | 75.9 | 110 | 16 |
| MRAH-G1T4.T164C | 3.8 | 3.2 | 88.7 | 111 | 16 |
| MRAH-G1T4.S165C | 7.8 | 4.1 | 81.5 | 112 | 16 |
| MRAH-G1T4.G166C | 4.5 | 2.2 | 89.4 | 113 | 16 |
| MRAH-G1T4.V167C | 5.5 | 2.5 | 81.2 | 114 | 16 |
| MRAH-G1T4.V173C | 2.1 | 1.6 | 92.2 | 115 | 16 |
| MRAH-G1T4.L174C | 19.8 | 0 | 67.1 | 116 | 16 |
| MRAH-G1T4.Q175C | 4.4 | 1.1 | 86.6 | 117 | 16 |
| MRAH-G1T4.S176C | 2.3 | 7.7 | 85.5 | 118 | 16 |
| MRAH-G1T4.S177C | 7.1 | 12.4 | 71.6 | 119 | 16 |
| MRAH-G1T4.G178C | 6.2 | 2.4 | 85.5 | 120 | 16 |
| MRAH-G1T4.L179C | 0.2 | 0 | 0 | 121 | 16 |
| MRAH-G1T4.Y180C | 0 | 0 | 72.7 | 122 | 16 |
| MRAH-G1T4.V186C | 0 | 0 | 73.3 | 123 | 16 |
| MRAH-G1T4.T187C | 0.8 | 2.5 | 90.3 | 124 | 16 |
| MRAH-G1T4.V188C | 0.3 | 4 | 82.7 | 125 | 16 |
| MRAH-G1T4.P189C | 0.9 | 4.7 | 89.6 | 126 | 16 |
| MRAH-G1T4.S190C | 10.9 | 0 | 74.4 | 127 | 16 |
| MRAH-G1T4.S191C | 2.3 | 46.4 | 45.1 | 128 | 16 |
| MRAH-G1T4.S192C | 1.3 | 11 | 83 | 129 | 16 |
| MRAH-G1T4.L193C | 3.6 | 0 | 70.5 | 130 | 16 |
| MRAH-G1T4.G194C | 13.8 | 0 | 0 | 131 | 16 |
| MRAH-G1T4.T195C | 29.6 | 0 | 57.3 | 132 | 16 |
| MRAH-G1T4.Q196C | 1.5 | 0 | 92.6 | 133 | 16 |
| MRAH-G1T4.T197C | 81.5 | 0 | 4.5 | 134 | 16 |
| MRAH-G1T4.Y198C | 0.1 | 0.3 | 17.1 | 135 | 16 |
| MRAH-G1T4.I199C | 1 | 1.7 | 91.6 | 136 | 16 |
| MRAH-G1T4.N201C | 0.7 | 4 | 90.3 | 137 | 16 |
| MRAH-G1T4.V202C | 0 | 0.1 | 6.6 | 138 | 16 |
| MRAH-G1T4.N203C | 0.6 | 2.4 | 89.8 | 139 | 16 |
| MRAH-G1T4.H204C | 0.4 | 2.2 | 77.7 | 140 | 16 |
| MRAH-G1T4.K205C | 0.2 | 2.3 | 85.5 | 141 | 16 |
| MRAH-G1T4.P206C | 0.4 | 2.1 | 86.9 | 142 | 16 |
| MRAH-G1T4.S207C | no data | no data | no data | 143 | 16 |
| MRAH-G1T4.N208C | 0.4 | 0 | 86.2 | 144 | 16 |
| MRAH-G1T4.T209C | 0.7 | 0 | 83.1 | 145 | 16 |
| MRAH-G1T4.K210C | 0.6 | 0 | 81.7 | 146 | 16 |
| MRAH-G1T4.V211C | 0.3 | 1 | 67.6 | 147 | 16 |
| MRAH-G1T4.D212C | 1.1 | 1.8 | 80.9 | 148 | 16 |
| MRAH-G1T4.K213C | 6.5 | 0 | 41.9 | 149 | 16 |
| MRAH-G1T4.R214C | 18.6 | 0 | 42.7 | 150 | 16 |
| MRAH-G1T4.V215C | 0 | 0 | 11.8 | 151 | 16 |
| MRAH-G1T4.E216C | 7.4 | 0 | 64.8 | 152 | 16 |
| MRAH-G1T4.P217C | 4.5 | 0.2 | 43.3 | 153 | 16 |
| MRAH-G1T4.K218C | 30.8 | 0 | 29.5 | 154 | 16 |
| MRAH-G1T4.S219C | 46.9 | 0.1 | 18 | 155 | 16 |

From this result, it was found that cysteine substitution in the heavy chain variable region or heavy chain constant region improved the protease resistance of the heavy chain hinge region in the MRA variants shown in Table 7. Alternatively, the result suggested that a Fab dimer was formed by a covalent bond between the Fab-Fab.

TABLE 7

MRA variants

| Antibody name | SEQ ID NO: | | | |
|---|---|---|---|---|
| | Heavy chain variable region | Heavy chain constant region | Light chain variable region | Light chain constant region |
| MRAH.G8C-G1T4 | 24 | 18 | 19 | 20 |
| MRAH.Q16C-G1T4 | 32 | 18 | 19 | 20 |
| MRAH.S28C-G1T4 | 41 | 18 | 19 | 20 |
| MRAH.S74C-G1T4 | 49 | 18 | 19 | 20 |
| MRAH.S82bC-G1T4 | 58 | 18 | 19 | 20 |
| MRAH-G1T4.S119C | 17 | 75 | 19 | 20 |
| MRAH-G1T4.G122C | 17 | 78 | 19 | 20 |
| MRAH-G1T4.P123C | 17 | 79 | 19 | 20 |
| MRAH-G1T4.S131C | 17 | 84 | 19 | 20 |
| MRAH-G1T4.S132C | 17 | 85 | 19 | 20 |
| MRAH-G1T4.K133C | 17 | 86 | 19 | 20 |
| MRAH-G1T4.S134C | 17 | 87 | 19 | 20 |
| MRAH-G1T4.T135C | 17 | 88 | 19 | 20 |
| MRAH-G1T4.S136C | 17 | 89 | 19 | 20 |
| MRAH-G1T4.G137C | 17 | 90 | 19 | 20 |
| MRAH-G1T4.T139C | 17 | 92 | 19 | 20 |
| MRAH-G1T4.A140C | 17 | 93 | 19 | 20 |
| MRAH-G1T4.D148C | 17 | 95 | 19 | 20 |
| MRAH-G1T4.F150C | 17 | 97 | 19 | 20 |
| MRAH-G1T4.T155C | 17 | 102 | 19 | 20 |
| MRAH-G1T4.V156C | 17 | 103 | 19 | 20 |
| MRAH-G1T4.S157C | 17 | 104 | 19 | 20 |
| MRAH-G1T4.N159C | 17 | 106 | 19 | 20 |
| MRAH-G1T4.S160C | 17 | 107 | 19 | 20 |
| MRAH-G1T4.G161C | 17 | 108 | 19 | 20 |
| MRAH-G1T4.A162C | 17 | 109 | 19 | 20 |
| MRAH-G1T4.L163C | 17 | 110 | 19 | 20 |
| MRAH-G1T4.S165C | 17 | 112 | 19 | 20 |
| MRAH-G1T4.V167C | 17 | 114 | 19 | 20 |
| MRAH-G1T4.L174C | 17 | 116 | 19 | 20 |
| MRAH-G1T4.S176C | 17 | 118 | 19 | 20 |
| MRAH-G1T4.S177C | 17 | 119 | 19 | 20 |
| MRAH-G1T4.G178C | 17 | 120 | 19 | 20 |
| MRAH-G1T4.S190C | 17 | 127 | 19 | 20 |
| MRAH-G1T4.S191C | 17 | 128 | 19 | 20 |
| MRAH-G1T4.S192C | 17 | 129 | 19 | 20 |
| MRAH-G1T4.G194C | 17 | 131 | 19 | 20 |
| MRAH-G1T4.T195C | 17 | 132 | 19 | 20 |
| MRAH-G1T4.T197C | 17 | 134 | 19 | 20 |
| MRAH-G1T4.K213C | 17 | 149 | 19 | 20 |
| MRAH-G1T4.R214C | 17 | 150 | 19 | 20 |
| MRAH-G1T4.E216C | 17 | 152 | 19 | 20 |
| MRAH-G1T4.K218C | 17 | 154 | 19 | 20 |
| MRAH-G1T4.S219C | 17 | 155 | 19 | 20 |

Example 6 Assessment of Antibodies Having Cysteine Substitution at Various Positions in the Light Chain Example 6-1 Assessment of Antibodies Having Cysteine Substitution at Various Nositions in the Light Chain The light chain variable region and constant region of an anti-human IL6R neutralizing antibody, MRA (heavy chain: MRAH-G1T4 (SEQ ID NO: 15), light chain: MRAL-k0 (SEQ ID NO: 16)) were subjected to a study in which an arbitrary amino acid residue structurally exposed to the surface was substituted with cysteine.

Amino acid residues within the light chain variable region of MRA (MRAL, SEQ ID NO: 19) were substituted with cysteine to produce variants of the light chain variable region of MRA shown in Table 8. These variants of the light chain variable region of MRA were each linked with the light chain constant region of MRA (k0, SEQ ID NO: 20) to produce variants of the light chain of MRA, and expression vectors encoding the corresponding genes were produced by a method known to the person skilled in the art.

In addition, amino acid residues within the light chain constant region of MRA (k0, SEQ ID NO: 20) were substituted with cysteine to produce variants of the light chain constant region of MRA shown in Table 9. These variants of the light chain constant region of MRA were each linked with the light chain variable region of MRA (MRAL, SEQ ID NO: 19) to produce variants of the light chain of MRA, and expression vectors encoding the corresponding genes were produced by a method known to the person skilled in the art.

The MRA light chain variants produced above were combined with the MRA heavy chain. The resultant MRA variants shown in Table 10 were expressed by transient expression using FreeStyle293 cells (Invitrogen) or Expi293 cells (Life technologies) by a method known to the person skilled in the art, and purified with Protein A by a method known to the person skilled in the art.

TABLE 8

Variants of MRA light chain variable region and position of cysteine substitution

| Variant of MRA light chain variable region | Position of cysteine substitution (Kabat numbering) | SEQ ID NO: |
|---|---|---|
| MRAL.T5C | 5 | 156 |
| MRAL.Q6C | 6 | 157 |
| MRAL.S7C | 7 | 158 |
| MRAL.P8C | 8 | 159 |
| MRAL.S9C | 9 | 160 |
| MRAL.S10C | 10 | 161 |
| MRAL.L11C | 11 | 162 |
| MRAL.S12C | 12 | 163 |
| MRAL.A13C | 13 | 164 |
| MRAL.S14C | 14 | 165 |
| MRAL.V15C | 15 | 166 |
| MRAL.G16C | 16 | 167 |
| MRAL.D17C | 17 | 168 |
| MRAL.R18C | 18 | 169 |
| MRAL.V19C | 19 | 170 |
| MRAL.T20C | 20 | 171 |
| MRAL.I21C | 21 | 172 |
| MRAL.T22C | 22 | 173 |
| MRAL.G57C | 57 | 174 |
| MRAL.V58C | 58 | 175 |
| MRAL.P59C | 59 | 176 |
| MRAL.S60C | 60 | 177 |
| MRAL.R61C | 61 | 178 |
| MRAL.F62C | 62 | 179 |
| MRAL.S63C | 63 | 180 |
| MRAL.S65C | 65 | 181 |
| MRAL.S67C | 67 | 182 |
| MRAL.G68C | 68 | 183 |
| MRAL.T69C | 69 | 184 |
| MRAL.D70C | 70 | 185 |
| MRAL.T72C | 72 | 186 |
| MRAL.F73C | 73 | 187 |
| MRAL.T74C | 74 | 188 |
| MRAL.I75C | 75 | 189 |
| MRAL.S76C | 76 | 190 |
| MRAL.S77C | 77 | 191 |
| MRAL.L78C | 78 | 192 |
| MRAL.Q79C | 79 | 193 |
| MRAL.F98C | 98 | 194 |
| MRAL.G99C | 99 | 195 |
| MRAL.Q100C | 100 | 196 |
| MRAL.G101C | 101 | 197 |

TABLE 8-continued

Variants of MRA light chain variable region and position of cysteine substitution

| Variant of MRA light chain variable region | Position of cysteine substitution (Kabat numbering) | SEQ ID NO: |
|---|---|---|
| MRAL.T102C | 102 | 198 |
| MRAL.K103C | 103 | 199 |
| MRAL.V104C | 104 | 200 |
| MRAL.E105C | 105 | 201 |
| MRAL.I106C | 106 | 202 |
| MRAL.K107C | 107 | 203 |
| MRAL.A25C | 25 | 204 |
| MRAL.S26C | 26 | 205 |
| MRAL.Q27C | 27 | 206 |
| MRAL.Y32C | 32 | 207 |
| MRAL.L33C | 33 | 208 |
| MRAL.N34C | 34 | 209 |
| MRAL.Y50C | 50 | 210 |
| MRAL.T51C | 51 | 211 |
| MRAL.H55C | 55 | 212 |
| MRAL.S56C | 56 | 213 |
| MRAL.Y96C | 96 | 214 |
| MRAL.T97C | 97 | 215 |

TABLE 9

Variants of MRA light chain constant region and position of cysteine substitution

| Variant of MRA light chain constant region | Position of cysteine substitution (EU numbering) | SEQ ID NO: |
|---|---|---|
| k0.R108C | 108 | 216 |
| k0.T109C | 109 | 217 |
| k0.V110C | 110 | 218 |
| k0.A111C | 111 | 219 |
| k0.A112C | 112 | 220 |
| k0.P113C | 113 | 221 |
| k0.S114C | 114 | 222 |
| k0.V115C | 115 | 223 |
| k0.F116C | 116 | 224 |
| k0.P120C | 120 | 225 |
| k0.S121C | 121 | 226 |
| k0.D122C | 122 | 227 |
| k0.E123C | 123 | 228 |
| k0.Q124C | 124 | 229 |
| k0.L125C | 125 | 230 |
| k0.K126C | 126 | 231 |
| k0.S127C | 127 | 232 |
| k0.G128C | 128 | 233 |
| k0.T129C | 129 | 234 |
| k0.A130C | 130 | 235 |
| k0.S131C | 131 | 236 |
| k0.L136C | 136 | 237 |
| k0.N137C | 137 | 238 |
| k0.N138C | 138 | 239 |
| k0.F139C | 139 | 240 |
| k0.Y140C | 140 | 241 |
| k0.P141C | 141 | 242 |
| k0.R142C | 142 | 243 |
| k0.E143C | 143 | 244 |
| k0.A144C | 144 | 245 |
| k0.K145C | 145 | 246 |
| k0.V146C | 146 | 247 |
| k0.Q147C | 147 | 248 |
| k0.W148C | 148 | 249 |
| k0.K149C | 149 | 250 |
| k0.V150C | 150 | 251 |
| k0.D151C | 151 | 252 |
| k0.N152C | 152 | 253 |
| k0.A153C | 153 | 254 |
| k0.L154C | 154 | 255 |
| k0.Q155C | 155 | 256 |
| k0.S156C | 156 | 257 |

TABLE 9-continued

Variants of MRA light chain constant region and position of cysteine substitution

| Variant of MRA light chain constant region | Position of cysteine substitution (EU numbering) | SEQ ID NO: |
|---|---|---|
| k0.G157C | 157 | 258 |
| k0.N158C | 158 | 259 |
| k0.S159C | 159 | 260 |
| k0.Q160C | 160 | 261 |
| k0.E161C | 161 | 262 |
| k0.S162C | 162 | 263 |
| k0.V163C | 163 | 264 |
| k0.T164C | 164 | 265 |
| k0.E165C | 165 | 266 |
| k0.Q166C | 166 | 267 |
| k0.D167C | 167 | 268 |
| k0.S168C | 168 | 269 |
| k0.K169C | 169 | 270 |
| k0.D170C | 170 | 271 |
| k0.S171C | 171 | 272 |
| k0.T172C | 172 | 273 |
| k0.Y173C | 173 | 274 |
| k0.S174C | 174 | 275 |
| k0.L175C | 175 | 276 |
| k0.T180C | 180 | 277 |
| k0.L181C | 181 | 278 |
| k0.S182C | 182 | 279 |
| k0.K183C | 183 | 280 |
| k0.A184C | 184 | 281 |
| k0.D185C | 185 | 282 |
| k0.Y186C | 186 | 283 |
| k0.E187C | 187 | 284 |
| k0.K188C | 188 | 285 |
| k0.H189C | 189 | 286 |
| k0.K190C | 190 | 287 |
| k0.V191C | 191 | 288 |
| k0.Y192C | 192 | 289 |
| k0.A193C | 193 | 290 |
| k0.E195C | 195 | 291 |
| k0.V196C | 196 | 292 |
| k0.T197C | 197 | 293 |
| k0.H198C | 198 | 294 |
| k0.Q199C | 199 | 295 |
| k0.G200C | 200 | 296 |
| k0.L201C | 201 | 297 |
| k0.S202C | 202 | 298 |
| k0.S203C | 203 | 299 |
| k0.P204C | 204 | 300 |
| k0.V205C | 205 | 301 |
| k0.T206C | 206 | 302 |
| k0.K207C | 207 | 303 |
| k0.S208C | 208 | 304 |
| k0.F209C | 209 | 305 |
| k0.N210C | 210 | 306 |
| k0.R211C | 211 | 307 |
| k0.G212C | 212 | 308 |
| k0.E213C | 213 | 309 |

TABLE 10

MRA variants

| Antibody name | SEQ ID NO: | | | |
|---|---|---|---|---|
| | Heavy chain variable region | Heavy chain constant region | Light chain variable region | Light chain constant region |
| MRAL.T5C-k0 | 17 | 18 | 156 | 20 |
| MRAL.Q6C-k0 | 17 | 18 | 157 | 20 |
| MRAL.S7C-k0 | 17 | 18 | 158 | 20 |
| MRAL.P8C-k0 | 17 | 18 | 159 | 20 |
| MRAL.S9C-k0 | 17 | 18 | 160 | 20 |
| MRAL.S10C-k0 | 17 | 18 | 161 | 20 |
| MRAL.L11C-k0 | 17 | 18 | 162 | 20 |
| MRAL.S12C-k0 | 17 | 18 | 163 | 20 |
| MRAL.A13C-k0 | 17 | 18 | 164 | 20 |
| MRAL.S14C-k0 | 17 | 18 | 165 | 20 |
| MRAL.V15C-k0 | 17 | 18 | 166 | 20 |
| MRAL.G16C-k0 | 17 | 18 | 167 | 20 |
| MRAL.D17C-k0 | 17 | 18 | 168 | 20 |
| MRAL.R18C-k0 | 17 | 18 | 169 | 20 |
| MRAL.V19C-k0 | 17 | 18 | 170 | 20 |
| MRAL.T20C-k0 | 17 | 18 | 171 | 20 |
| MRAL.I21C-k0 | 17 | 18 | 172 | 20 |
| MRAL.T22C-k0 | 17 | 18 | 173 | 20 |
| MRAL.G57C-k0 | 17 | 18 | 174 | 20 |
| MRAL.V58C-k0 | 17 | 18 | 175 | 20 |
| MRAL.P59C-k0 | 17 | 18 | 176 | 20 |
| MRAL.S60C-k0 | 17 | 18 | 177 | 20 |
| MRAL.R61C-k0 | 17 | 18 | 178 | 20 |
| MRAL.F62C-k0 | 17 | 18 | 179 | 20 |
| MRAL.S63C-k0 | 17 | 18 | 180 | 20 |
| MRAL.S65C-k0 | 17 | 18 | 181 | 20 |
| MRAL.S67C-k0 | 17 | 18 | 182 | 20 |
| MRAL.G68C-k0 | 17 | 18 | 183 | 20 |
| MRAL.T69C-k0 | 17 | 18 | 184 | 20 |
| MRAL.D70C-k0 | 17 | 18 | 185 | 20 |
| MRAL.T72C-k0 | 17 | 18 | 186 | 20 |
| MRAL.F73C-k0 | 17 | 18 | 187 | 20 |
| MRAL.T74C-k0 | 17 | 18 | 188 | 20 |
| MRAL.I75C-k0 | 17 | 18 | 189 | 20 |
| MRAL.S76C-k0 | 17 | 18 | 190 | 20 |
| MRAL.S77C-k0 | 17 | 18 | 191 | 20 |
| MRAL.L78C-k0 | 17 | 18 | 192 | 20 |
| MRAL.Q79C-k0 | 17 | 18 | 193 | 20 |
| MRAL.F98C-k0 | 17 | 18 | 194 | 20 |
| MRAL.G99C-k0 | 17 | 18 | 195 | 20 |
| MRAL.Q100C-k0 | 17 | 18 | 196 | 20 |
| MRAL.G101C-k0 | 17 | 18 | 197 | 20 |
| MRAL.T102C-k0 | 17 | 18 | 198 | 20 |
| MRAL.K103C-k0 | 17 | 18 | 199 | 20 |
| MRAL.V104C-k0 | 17 | 18 | 200 | 20 |
| MRAL.E105C-k0 | 17 | 18 | 201 | 20 |
| MRAL.I106C-k0 | 17 | 18 | 202 | 20 |
| MRAL.K107C-k0 | 17 | 18 | 203 | 20 |
| MRAL.A25C-k0 | 17 | 18 | 204 | 20 |
| MRAL.S26C-k0 | 17 | 18 | 205 | 20 |
| MRAL.Q27C-k0 | 17 | 18 | 206 | 20 |
| MRAL.Y32C-k0 | 17 | 18 | 207 | 20 |
| MRAL.L33C-k0 | 17 | 18 | 208 | 20 |
| MRAL.N34C-k0 | 17 | 18 | 209 | 20 |
| MRAL.Y50C-k0 | 17 | 18 | 210 | 20 |
| MRAL.T51C-k0 | 17 | 18 | 211 | 20 |
| MRAL.H55C-k0 | 17 | 18 | 212 | 20 |
| MRAL.S56C-k0 | 17 | 18 | 213 | 20 |
| MRAL.Y96C-k0 | 17 | 18 | 214 | 20 |
| MRAL.T97C-k0 | 17 | 18 | 215 | 20 |
| MRAL-k0.R108C | 17 | 18 | 19 | 216 |
| MRAL-k0.T109C | 17 | 18 | 19 | 217 |
| MRAL-k0.V110C | 17 | 18 | 19 | 218 |
| MRAL-k0.A111C | 17 | 18 | 19 | 219 |
| MRAL-k0.A112C | 17 | 18 | 19 | 220 |
| MRAL-k0.P113C | 17 | 18 | 19 | 221 |
| MRAL-k0.S114C | 17 | 18 | 19 | 222 |
| MRAL-k0.V115C | 17 | 18 | 19 | 223 |
| MRAL-k0.F116C | 17 | 18 | 19 | 224 |
| MRAL-k0.P120C | 17 | 18 | 19 | 225 |
| MRAL-k0.S121C | 17 | 18 | 19 | 226 |
| MRAL-k0.D122C | 17 | 18 | 19 | 227 |
| MRAL-k0.E123C | 17 | 18 | 19 | 228 |
| MRAL-k0.Q124C | 17 | 18 | 19 | 229 |
| MRAL-k0.L125C | 17 | 18 | 19 | 230 |
| MRAL-k0.K126C | 17 | 18 | 19 | 231 |
| MRAL-k0.S127C | 17 | 18 | 19 | 232 |

TABLE 10-continued

MRA variants

| Antibody name | Heavy chain variable region | Heavy chain constant region | Light chain variable region | Light chain constant region |
|---|---|---|---|---|
| | SEQ ID NO: | | | |
| MRAL-k0.G128C | 17 | 18 | 19 | 233 |
| MRAL-k0.T129C | 17 | 18 | 19 | 234 |
| MRAL-k0.A130C | 17 | 18 | 19 | 235 |
| MRAL-k0.S131C | 17 | 18 | 19 | 236 |
| MRAL-k0.L136C | 17 | 18 | 19 | 237 |
| MRAL-k0.N137C | 17 | 18 | 19 | 238 |
| MRAL-k0.N138C | 17 | 18 | 19 | 239 |
| MRAL-k0.F139C | 17 | 18 | 19 | 240 |
| MRAL-k0.Y140C | 17 | 18 | 19 | 241 |
| MRAL-k0.P141C | 17 | 18 | 19 | 242 |
| MRAL-k0.R142C | 17 | 18 | 19 | 243 |
| MRAL-k0.E143C | 17 | 18 | 19 | 244 |
| MRAL-k0.A144C | 17 | 18 | 19 | 245 |
| MRAL-k0.K145C | 17 | 18 | 19 | 246 |
| MRAL-k0.V146C | 17 | 18 | 19 | 247 |
| MRAL-k0.Q147C | 17 | 18 | 19 | 248 |
| MRAL-k0.W148C | 17 | 18 | 19 | 249 |
| MRAL-k0.K149C | 17 | 18 | 19 | 250 |
| MRAL-k0.V150C | 17 | 18 | 19 | 251 |
| MRAL-k0.D151C | 17 | 18 | 19 | 252 |
| MRAL-k0.N152C | 17 | 18 | 19 | 253 |
| MRAL-k0.A153C | 17 | 18 | 19 | 254 |
| MRAL-k0.L154C | 17 | 18 | 19 | 255 |
| MRAL-k0.Q155C | 17 | 18 | 19 | 256 |
| MRAL-k0.S156C | 17 | 18 | 19 | 257 |
| MRAL-k0.G157C | 17 | 18 | 19 | 258 |
| MRAL-k0.N158C | 17 | 18 | 19 | 259 |
| MRAL-k0.S159C | 17 | 18 | 19 | 260 |
| MRAL-k0.Q160C | 17 | 18 | 19 | 261 |
| MRAL-k0.E161C | 17 | 18 | 19 | 262 |
| MRAL-k0.S162C | 17 | 18 | 19 | 263 |
| MRAL-k0.V163C | 17 | 18 | 19 | 264 |
| MRAL-k0.T164C | 17 | 18 | 19 | 265 |
| MRAL-k0.E165C | 17 | 18 | 19 | 266 |
| MRAL-k0.Q166C | 17 | 18 | 19 | 267 |
| MRAL-k0.D167C | 17 | 18 | 19 | 268 |
| MRAL-k0.S168C | 17 | 18 | 19 | 269 |
| MRAL-k0.K169C | 17 | 18 | 19 | 270 |
| MRAL-k0.D170C | 17 | 18 | 19 | 271 |
| MRAL-k0.S171C | 17 | 18 | 19 | 272 |
| MRAL-k0.T172C | 17 | 18 | 19 | 273 |
| MRAL-k0.Y173C | 17 | 18 | 19 | 274 |
| MRAL-k0.S174C | 17 | 18 | 19 | 275 |
| MRAL-k0.L175C | 17 | 18 | 19 | 276 |
| MRAL-k0.T180C | 17 | 18 | 19 | 277 |
| MRAL-k0.L181C | 17 | 18 | 19 | 278 |
| MRAL-k0.S182C | 17 | 18 | 19 | 279 |
| MRAL-k0.K183C | 17 | 18 | 19 | 280 |
| MRAL-k0.A184C | 17 | 18 | 19 | 281 |
| MRAL-k0.D185C | 17 | 18 | 19 | 282 |
| MRAL-k0.Y186C | 17 | 18 | 19 | 283 |
| MRAL-k0.E187C | 17 | 18 | 19 | 284 |
| MRAL-k0.K188C | 17 | 18 | 19 | 285 |
| MRAL-k0.H189C | 17 | 18 | 19 | 286 |
| MRAL-k0.K190C | 17 | 18 | 19 | 287 |
| MRAL-k0.V191C | 17 | 18 | 19 | 288 |
| MRAL-k0.Y192C | 17 | 18 | 19 | 289 |
| MRAL-k0.A193C | 17 | 18 | 19 | 290 |
| MRAL-k0.E195C | 17 | 18 | 19 | 291 |
| MRAL-k0.V196C | 17 | 18 | 19 | 292 |
| MRAL-k0.T197C | 17 | 18 | 19 | 293 |
| MRAL-k0.H198C | 17 | 18 | 19 | 294 |
| MRAL-k0.Q199C | 17 | 18 | 19 | 295 |
| MRAL-k0.G200C | 17 | 18 | 19 | 296 |
| MRAL-k0.L201C | 17 | 18 | 19 | 297 |
| MRAL-k0.S202C | 17 | 18 | 19 | 298 |
| MRAL-k0.S203C | 17 | 18 | 19 | 299 |
| MRAL-k0.P204C | 17 | 18 | 19 | 300 |
| MRAL-k0.V205C | 17 | 18 | 19 | 301 |
| MRAL-k0.T206C | 17 | 18 | 19 | 302 |
| MRAL-k0.K207C | 17 | 18 | 19 | 303 |
| MRAL-k0.S208C | 17 | 18 | 19 | 304 |
| MRAL-k0.F209C | 17 | 18 | 19 | 305 |
| MRAL-k0.N210C | 17 | 18 | 19 | 306 |
| MRAL-k0.R211C | 17 | 18 | 19 | 307 |
| MRAL-k0.G212C | 17 | 18 | 19 | 308 |
| MRAL-k0.E213C | 17 | 18 | 19 | 309 |

Example 6-2 Assessment of Protease-Mediated Fab Fragmentation of Antibodies Having Cysteine Substitution at Various Positions in the Light Chain Using a protease that cleaves the heavy chain hinge region of antibody to cause Fab fragmentation, the MRA variants produced in Example 6-1 were examined for whether they acquired protease resistance so that their fragmentation would be inhibited. The protease used was Lys-C(Endoproteinase Lys-C Sequencing Grade) (SIGMA; 11047825001). Reaction was performed under the conditions of 2 ng/µL protease, 100 µg/mL antibody, 80% 25 mM Tris-HCl pH 8.0, 20% PBS, and 35° C. for two hours, or under the conditions of 2 ng/µL protease, 20 µg/mL antibody, 80% 25 mM Tris-HCl pH 8.0, 20% PBS, and 35° C. for one hour. The sample was then subjected to non-reducing capillary electrophoresis. Wes (Protein Simple) was used for capillary electrophoresis, and an HRP-labeled anti-kappa chain antibody (abcam; ab46527) was used for detection. The results are shown in FIGS. 14 to 23. Lys-C treatment of MRA caused cleavage of the heavy chain hinge region, resulting in disappearance of the band of IgG at around 150 kDa and appearance of the band of Fab at around 50 kDa. For the MRA variants produced in Example 6-1, some showed the band of Fab dimer appearing at around 96 kDa and some showed the band of undigested IgG detected at around 150 kDa after the protease treatment. The area of each band obtained after the protease treatment was outputted using software dedicated for Wes (Compass for SW; Protein Simple) to calculate the percentage of the band areas of undigested IgG, Fab dimer, etc. The calculated percentage of each band is shown in Table 11.

TABLE 11

| Antibody name | IgG (%) | Fab-Fab (%) | Fab (%) | Heavy chain SEQ ID NO: | Light chain SEQ ID NO: |
|---|---|---|---|---|---|
| MRAL.T5C-k0 | 0.1 | 0 | 71.1 | 15 | 156 |
| MRAL.Q6C-k0 | 0.1 | 0 | 74.5 | 15 | 157 |
| MRAL.S7C-k0 | 0.2 | 0 | 68.8 | 15 | 158 |
| MRAL.P8C-k0 | no data | no data | no data | 15 | 159 |
| MRAL.S9C-k0 | 0.3 | 0.4 | 82.9 | 15 | 160 |
| MRAL.S10C-k0 | 0.2 | 0.4 | 85.8 | 15 | 161 |
| MRAL.L11C-k0 | 0 | 0 | 83.4 | 15 | 162 |
| MRAL.S12C-k0 | 0.9 | 0.4 | 87.2 | 15 | 163 |
| MRAL.A13C-k0 | 0.1 | 0 | 88.6 | 15 | 164 |
| MRAL.S14C-k0 | 0.3 | 0.6 | 85.9 | 15 | 165 |
| MRAL.V15C-k0 | 0.2 | 0 | 84.8 | 15 | 166 |
| MRAL.G16C-k0 | 0.8 | 0 | 82.3 | 15 | 167 |
| MRAL.D17C-k0 | 0 | 0 | 92.3 | 15 | 168 |

TABLE 11-continued

| Antibody name | IgG (%) | Fab-Fab (%) | Fab (%) | Heavy chain SEQ ID NO: | Light chain SEQ ID NO: |
|---|---|---|---|---|---|
| MRAL.R18C-k0 | 0.2 | 0.4 | 87.1 | 15 | 169 |
| MRAL.V19C-k0 | 0 | 0 | 63.3 | 15 | 170 |
| MRAL.T20C-k0 | 0.5 | 0.6 | 83.6 | 15 | 171 |
| MRAL.I21C-k0 | 0 | 0 | 5 | 15 | 172 |
| MRAL.T22C-k0 | 0 | 0.3 | 89.5 | 15 | 173 |
| MRAL.G57C-k0 | 0.2 | 0 | 91.7 | 15 | 174 |
| MRAL.V58C-k0 | 0.4 | 0.7 | 88 | 15 | 175 |
| MRAL.P59C-k0 | 0.7 | 1.5 | 94.6 | 15 | 176 |
| MRAL.S60C-k0 | 0.1 | 0 | 86.9 | 15 | 177 |
| MRAL.R61C-k0 | 0 | 0.3 | 86.9 | 15 | 178 |
| MRAL.F62C-k0 | 0.2 | 0 | 60 | 15 | 179 |
| MRAL.S63C-k0 | 0.5 | 0.6 | 88.1 | 15 | 180 |
| MRAL.S65C-k0 | 0.4 | 0.8 | 83.3 | 15 | 181 |
| MRAL.S67C-k0 | 1.5 | 0 | 72.8 | 15 | 182 |
| MRAL.G68C-k0 | 0.7 | 0.9 | 83.9 | 15 | 183 |
| MRAL.T69C-k0 | 1.1 | 0.6 | 86.4 | 15 | 184 |
| MRAL.D70C-k0 | 0.8 | 0.9 | 88.2 | 15 | 185 |
| MRAL.T72C-k0 | 0.6 | 0.7 | 90.1 | 15 | 186 |
| MRAL.F73C-k0 | 0.3 | 0 | 59.5 | 15 | 187 |
| MRAL.T74C-k0 | 0.2 | 0.6 | 95.6 | 15 | 188 |
| MRAL.I75C-k0 | no data | no data | no data | 15 | 189 |
| MRAL.S76C-k0 | 0.6 | 0.8 | 90.4 | 15 | 190 |
| MRAL.S77C-k0 | 1.1 | 0 | 74.2 | 15 | 191 |
| MRAL.L78C-k0 | 4.9 | 0 | 54.7 | 15 | 192 |
| MRAL.Q79C-k0 | 1.2 | 0.6 | 93.1 | 15 | 193 |
| MRAL.F98C-k0 | 0.6 | 0.8 | 71.8 | 15 | 194 |
| MRAL.G99C-k0 | 0.6 | 0.4 | 88.2 | 15 | 195 |
| MRAL.Q100C-k0 | 5 | 0.8 | 85 | 15 | 196 |
| MRAL.G101C-k0 | 0.3 | 0.4 | 98.1 | 15 | 197 |
| MRAL.T102C-k0 | 0.3 | 0 | 52.8 | 15 | 198 |
| MRAL.K103C-k0 | 1.1 | 0.4 | 89.2 | 15 | 199 |
| MRAL.V104C-k0 | 0.2 | 0.6 | 48.2 | 15 | 200 |
| MRAL.E105C-k0 | 90.8 | 0 | 1.2 | 15 | 201 |
| MRAL.I106C-k0 | 1.8 | 0 | 47.3 | 15 | 202 |
| MRAL.K107C-k0 | 5.4 | 0 | 82.6 | 15 | 203 |
| MRAL.A25C-k0 | 0.1 | 0.5 | 80 | 15 | 204 |
| MRAL.S26C-k0 | 0.3 | 1.4 | 94 | 15 | 205 |
| MRAL.Q27C-k0 | 0.3 | 1.3 | 94.6 | 15 | 206 |
| MRAL.Y32C-k0 | 0 | 1.2 | 95.7 | 15 | 207 |
| MRAL.L33C-k0 | 0 | 0 | 79.2 | 15 | 208 |
| MRAL.N34C-k0 | 0.3 | 0.4 | 95.7 | 15 | 209 |
| MRAL.Y50C-k0 | 0.4 | 1.3 | 97 | 15 | 210 |
| MRAL.T51C-k0 | 0.2 | 1.2 | 96.9 | 15 | 211 |
| MRAL.H55C-k0 | 0.2 | 1.5 | 95.7 | 15 | 212 |
| MRAL.S56C-k0 | 0.1 | 0.8 | 97 | 15 | 213 |
| MRAL.Y96C-k0 | 0.1 | 0.2 | 91.3 | 15 | 214 |
| MRAL.T97C-k0 | 0.3 | 0.9 | 97.5 | 15 | 215 |
| MRAL-k0.R108C | no data | no data | no data | 15 | 216 |
| MRAL-k0.T109C | 0.5 | 16 | 74.5 | 15 | 217 |
| MRAL-k0.V110C | 1.2 | 4 | 75 | 15 | 218 |
| MRAL-k0.A111C | 0.2 | 0.7 | 85.9 | 15 | 219 |
| MRAL-k0.A112C | 3.3 | 6.1 | 80.3 | 15 | 220 |
| MRAL-k0.P113C | no data | no data | no data | 15 | 221 |
| MRAL-k0.S114C | 0.3 | 0.7 | 94 | 15 | 222 |
| MRAL-k0.V115C | 0 | 0.1 | 34.9 | 15 | 223 |
| MRAL-k0.F116C | 0.3 | 0.3 | 77.3 | 15 | 224 |
| MRAL-k0.P120C | 0 | 0 | 28.8 | 15 | 225 |
| MRAL-k0.S121C | 8.6 | 0 | 57.4 | 15 | 226 |
| MRAL-k0.D122C | 1.8 | 0.1 | 30.3 | 15 | 227 |
| MRAL-k0.E123C | 2.3 | 1.6 | 75.9 | 15 | 228 |
| MRAL-k0.Q124C | 1.3 | 0.9 | 50.4 | 15 | 229 |
| MRAL-k0.L125C | 0.4 | 0.1 | 66.6 | 15 | 230 |
| MRAL-k0.K126C | 59.3 | 9.9 | 16.5 | 15 | 231 |
| MRAL-k0.S127C | 0.3 | 0.9 | 79 | 15 | 232 |
| MRAL-k0.G128C | 0.2 | 7 | 71.5 | 15 | 233 |
| MRAL-k0.T129C | 0 | 0.4 | 76.2 | 15 | 234 |
| MRAL-k0.A130C | 0 | 0 | 49.9 | 15 | 235 |
| MRAL-k0.S131C | 0 | 0 | 16.7 | 15 | 236 |
| MRAL-k0.L136C | 0 | 0 | 15 | 15 | 237 |
| MRAL-k0.N137C | 0 | 0 | 47.5 | 15 | 238 |
| MRAL-k0.N138C | 0 | 0.5 | 86.8 | 15 | 239 |
| MRAL-k0.F139C | 0 | 0 | 0 | 15 | 240 |
| MRAL-k0.Y140C | 0 | 0 | 29.9 | 15 | 241 |
| MRAL-k0.P141C | 0.1 | 2.7 | 79.8 | 15 | 242 |
| MRAL-k0.R142C | 0 | 0.6 | 74.1 | 15 | 243 |
| MRAL-k0.E143C | 0 | 0.5 | 88.4 | 15 | 244 |
| MRAL-k0.A144C | 0 | 0.1 | 42.1 | 15 | 245 |
| MRAL-k0.K145C | 0 | 0.9 | 82.8 | 15 | 246 |
| MRAL-k0.V146C | 0 | 0 | 26.5 | 15 | 247 |
| MRAL-k0.Q147C | 0 | 1.8 | 78.5 | 15 | 248 |
| MRAL-k0.W148C | no data | no data | no data | 15 | 249 |
| MRAL-k0.K149C | 0 | 0.6 | 79.5 | 15 | 250 |
| MRAL-k0.V150C | 0 | 0 | 34.8 | 15 | 251 |
| MRAL-k0.D151C | 2.7 | 14.9 | 66.5 | 15 | 252 |
| MRAL-k0.N152C | 1.2 | 58.4 | 26.8 | 15 | 253 |
| MRAL-k0.A153C | 0 | 7.1 | 71.8 | 15 | 254 |
| MRAL-k0.L154C | 0 | 2.3 | 66.5 | 15 | 255 |
| MRAL-k0.Q155C | 0 | 0.6 | 73.3 | 15 | 256 |
| MRAL-k0.S156C | 0.3 | 32.3 | 40.5 | 15 | 257 |
| MRAL-k0.G157C | 0 | 1.4 | 71.8 | 15 | 258 |
| MRAL-k0.N158C | 0 | 0.7 | 76.2 | 15 | 259 |
| MRAL-k0.S159C | 0 | 1.1 | 74.7 | 15 | 260 |
| MRAL-k0.Q160C | 0 | 1.5 | 78.5 | 15 | 261 |
| MRAL-k0.E161C | 0 | 1 | 79.8 | 15 | 262 |
| MRAL-k0.S162C | 0.6 | 1.6 | 86.7 | 15 | 263 |
| MRAL-k0.V163C | 0 | 1.7 | 87.1 | 15 | 264 |
| MRAL-k0.T164C | 0 | 2.6 | 84.3 | 15 | 265 |
| MRAL-k0.E165C | 0 | 0.6 | 89.5 | 15 | 266 |
| MRAL-k0.Q166C | 0 | 2 | 86.2 | 15 | 267 |
| MRAL-k0.D167C | 0 | 0.5 | 90.5 | 15 | 268 |
| MRAL-k0.S168C | 0 | 0.8 | 94.1 | 15 | 269 |
| MRAL-k0.K169C | 0 | 0.4 | 95.3 | 15 | 270 |
| MRAL-k0.D170C | 0.2 | 0.1 | 96 | 15 | 271 |
| MRAL-k0.S171C | 0 | 0.1 | 93.8 | 15 | 272 |
| MRAL-k0.T172C | 0 | 0 | 77.4 | 15 | 273 |
| MRAL-k0.Y173C | no data | no data | no data | 15 | 274 |
| MRAL-k0.S174C | 0 | 0 | 65.8 | 15 | 275 |
| MRAL-k0.L175C | 0 | 0.2 | 59.3 | 15 | 276 |
| MRAL-k0.T180C | 0 | 0.3 | 93.3 | 15 | 277 |
| MRAL-k0.L181C | 1.3 | 0.6 | 86.4 | 15 | 278 |
| MRAL-k0.S182C | 0.9 | 1.9 | 95 | 15 | 279 |
| MRAL-k0.K183C | 4.4 | 0.9 | 90.7 | 15 | 280 |
| MRAL-k0.A184C | 1.6 | 27.9 | 67.7 | 15 | 281 |
| MRAL-k0.D185C | 0.5 | 1.1 | 96.5 | 15 | 282 |
| MRAL-k0.Y186C | 2.4 | 18.9 | 67.4 | 15 | 283 |
| MRAL-k0.E187C | 2.3 | 0 | 11.2 | 15 | 284 |
| MRAL-k0.K188C | 1.8 | 8.6 | 85.8 | 15 | 285 |
| MRAL-k0.H189C | 1 | 0.8 | 93 | 15 | 286 |
| MRAL-k0.K190C | 25.5 | 0.2 | 11.4 | 15 | 287 |
| MRAL-k0.V191C | 2.8 | 1.6 | 84 | 15 | 288 |
| MRAL-k0.Y192C | 0.4 | 1.1 | 67.5 | 15 | 289 |
| MRAL-k0.A193C | 1.7 | 1.4 | 94.5 | 15 | 290 |
| MRAL-k0.E195C | 0.9 | 1.7 | 95.5 | 15 | 291 |
| MRAL-k0.V196C | 1 | 1.1 | 67.5 | 15 | 292 |
| MRAL-k0.T197C | 0.8 | 1.5 | 94.8 | 15 | 293 |
| MRAL-k0.H198C | 0.7 | 1.3 | 85 | 15 | 294 |
| MRAL-k0.Q199C | 1.4 | 2.5 | 92.9 | 15 | 295 |
| MRAL-k0.G200C | 7.3 | 14.8 | 75.6 | 15 | 296 |
| MRAL-k0.L201C | 1.7 | 5 | 88 | 15 | 297 |
| MRAL-k0.S202C | 2.8 | 46.4 | 49.4 | 15 | 298 |
| MRAL-k0.S203C | 9.1 | 0 | 87.1 | 15 | 299 |
| MRAL-k0.P204C | 1 | 0 | 95.8 | 15 | 300 |
| MRAL-k0.V205C | 1.7 | 1 | 88.4 | 15 | 301 |
| MRAL-k0.T206C | 1.4 | 0.7 | 90.1 | 15 | 302 |
| MRAL-k0.K207C | 3.2 | 0.5 | 79.8 | 15 | 303 |
| MRAL-k0.S208C | 7.7 | 0.8 | 77.8 | 15 | 304 |
| MRAL-k0.F209C | 0 | 0 | 37.2 | 15 | 305 |
| MRAL-k0.N210C | 22.8 | 0 | 20.2 | 15 | 306 |
| MRAL-k0.R211C | 9.2 | 0 | 59.7 | 15 | 307 |
| MRAL-k0.G212C | 58.9 | 0 | 28.7 | 15 | 308 |
| MRAL-k0.E213C | 55.1 | 0 | 12.1 | 15 | 309 |

From this result, it was found that cysteine substitution in the light chain variable region or light chain constant region improved the protease resistance of the heavy chain hinge region in the MRA variants shown in Table 12. Alternatively, the result suggested that a Fab dimer was formed by a covalent bond between the Fab-Fab.

TABLE 12

MRA variants

| Antibody name | SEQ ID NO: | | | |
|---|---|---|---|---|
| | Heavy chain variable region | Heavy chain constant region | Light chain variable region | Light chain constant region |
| MRAL.Q100C-k0 | 17 | 18 | 196 | 20 |
| MRAL.E105C-k0 | 17 | 18 | 201 | 20 |
| MRAL.K107C-k0 | 17 | 18 | 203 | 20 |
| MRAL-k0.T109C | 17 | 18 | 19 | 217 |
| MRAL-k0.A112C | 17 | 18 | 19 | 220 |
| MRAL-k0.S121C | 17 | 18 | 19 | 226 |
| MRAL-k0.K126C | 17 | 18 | 19 | 231 |
| MRAL-k0.G128C | 17 | 18 | 19 | 233 |
| MRAL-k0.D151C | 17 | 18 | 19 | 252 |
| MRAL-k0.N152C | 17 | 18 | 19 | 253 |
| MRAL-k0.A153C | 17 | 18 | 19 | 254 |
| MRAL-k0.S156C | 17 | 18 | 19 | 257 |
| MRAL-k0.A184C | 17 | 18 | 19 | 281 |
| MRAL-k0.Y186C | 17 | 18 | 19 | 283 |
| MRAL-k0.K188C | 17 | 18 | 19 | 285 |
| MRAL-k0.K190C | 17 | 18 | 19 | 287 |
| MRAL-k0.G200C | 17 | 18 | 19 | 296 |
| MRAL-k0.L201C | 17 | 18 | 19 | 297 |
| MRAL-k0.S202C | 17 | 18 | 19 | 298 |
| MRAL-k0.S203C | 17 | 18 | 19 | 299 |
| MRAL-k0.S208C | 17 | 18 | 19 | 304 |
| MRAL-k0.N210C | 17 | 18 | 19 | 306 |
| MRAL-k0.R211C | 17 | 18 | 19 | 307 |
| MRAL-k0.G212C | 17 | 18 | 19 | 308 |
| MRAL-k0.E213C | 17 | 18 | 19 | 309 |

Example 7 Study of Methods for Assessing Antibodies Having Cysteine Substitution

Example 7-1 Production of Antibodies Having Cysteine Substitution in the Light Chain The amino acid residue at position 126 according to Kabat numbering in the light chain constant region (k0, SEQ ID NO: 20) of MRA, an anti-human IL6R neutralizing antibody (heavy chain: MRAH-G1T4 (SEQ ID NO: 15), light chain: MRAL-k0 (SEQ ID NO: 16)), was substituted with cysteine to produce a variant of the light chain constant region of MRA, k0.K126C (SEQ ID No: 231). This variant of the light chain constant region of MRA was linked with the MRA light chain variable region (MRAL, SEQ ID NO: 19) to produce a variant of the light chain of MRA, and an expression vector encoding the corresponding gene was produced by a method known to the person skilled in the art.

The MRA light chain variant produced above was combined with the MRA heavy chain. The resultant MRA variant MRAL-k0.K126C (heavy chain: MRAH-G1T4 (SEQ ID NO: 15), light chain variable region: MRAL (SEQ ID NO: 19), light chain constant region: k0.K126C (SEQ ID NO: 231)) was expressed by transient expression using FreeStyle293 cells (Invitrogen) or Expi293 cells (Life technologies) by a method known to the person skilled in the art, and purified with Protein A by a method known to the person skilled in the art.

Figure 24:
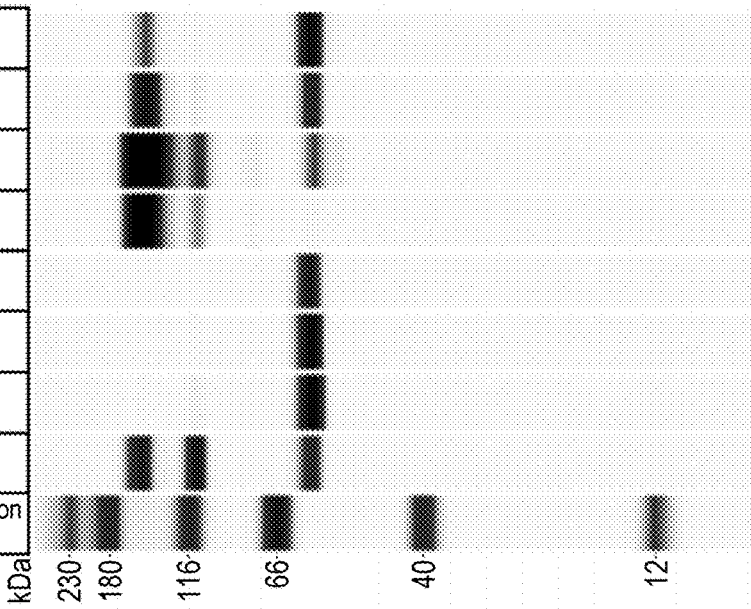
FIG. 24 shows the results of protease treatment of an anti-IL6R antibody (MRA) and a modified antibody produced by introducing a cysteine substitution into the light chain constant region of the anti-IL6R antibody (MRAL-k0.K126C), as described in Example 7-2. Each protease-treated antibody was applied to non-reducing capillary electrophoresis, followed by band detection with an anti-kappa chain antibody or an anti-human Fc antibody.
Figure 24:
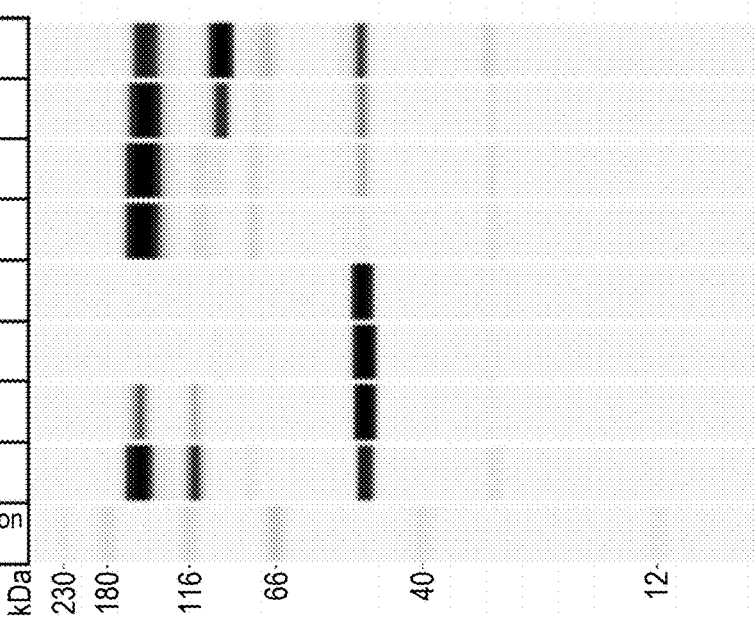
Figure 25:
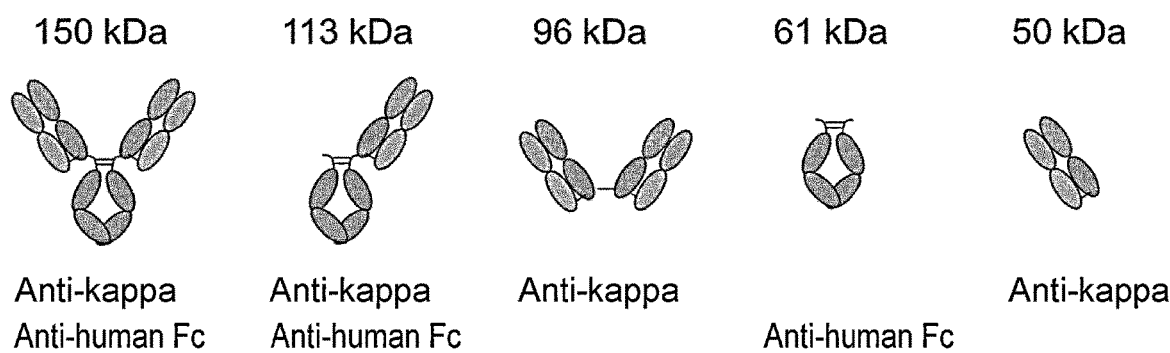
FIG. 25 shows the correspondence between the molecular weight of each band obtained by protease treatment of the antibody sample and its putative structure, as described in Example 7-2. It is also noted below the structure of each molecule whether the molecule may react with an anti-kappa chain antibody or an anti-Fc antibody (whether a band is detected in the electrophoresis of FIG. 24).

Example 7-2 Assessment of Protease-Mediated Capillary Electrophoresis of Antibodies Having Cysteine Substitution in the Light Chain Using a protease that cleaves the heavy chain hinge region of antibody to cause Fab fragmentation, the MRA light chain variant produced in Example 7-1 was examined for whether it acquired protease resistance so that its fragmentation would be inhibited. The protease used was Lys-C(Endoproteinase Lys-C Sequencing Grade) (SIGMA; 11047825001). Reaction was performed under the conditions of 0.1, 0.4, 1.6, or 6.4 ng/μL protease, 100 μg/mL antibody, 80% 25 mM Tris-HCl pH 8.0, 20% PBS, and 35° C. for two hours. The sample was then subjected to non-reducing capillary electrophoresis. Wes (Protein Simple) was used for capillary electrophoresis, and an HRP-labeled anti-kappa chain antibody (abcam; ab46527) or an HRP-labeled anti-human Fc antibody (Protein Simple; 043-491) was used for detection. The result is shown in FIG. 24. For MRA treated with Lys-C, detection with the anti-kappa chain antibody showed disappearance of the band at around 150 kDa and appearance of a new band at around 50 kDa, and, at low Lys-C concentrations, also showed appearance of a slight band at 113 kDa. Detection with the anti-human Fc antibody showed disappearance of the band at around 150 kDa and appearance of a new band at around 61 kDa, and, at low Lys-C concentrations, also showed appearance of a slight band at 113 kDa. For the MRA variant produced in Example 7-1, on the other hand, the band at around 150 kDa hardly disappeared, and a new band appeared at around 96 kDa. Detection with the anti-human Fc antibody showed that the band at around 150 kDa hardly disappeared and a new band appeared at around 61 kDa, and, at low Lys-C concentrations, a slight band also appeared at 113 kDa. The above results suggested that, as shown in FIG. 25, the band at around 150 kDa was IgG, the band at around 113 kDa was a one-arm form in which the heavy chain hinge was cleaved once, the band at around 96 kDa was a Fab dimer, the band at around 61 kDa was Fc, and the band at around 50 kDa was Fab.

Example 8 Assessment of Antibodies Having Cysteine Substitution at Various Positions of IgG1

Example 8-1 Production of Antibodies Having Cysteine Substitution at Various Positions of IgG1

The heavy chain and light chain of an anti-human IL6R neutralizing antibody, MRA-IgG1 (heavy chain: MRAH-G1T4 (SEQ ID NO: 15), light chain: MRAL-k0 (SEQ ID NO: 16)), were subjected to a study in which an arbitrary amino acid residue structurally exposed to the surface was substituted with cysteine.

Amino acid residues within the MRA-IgG1 heavy chain variable region (MRAH, SEQ ID NO: 17) were substituted with cysteine to produce variants of the MRA-IgG1 heavy chain variable region shown in Table 13. These variants of the MRA-IgG1 heavy chain variable region were each linked with the MRA-IgG1 heavy chain constant region (G1T4, SEQ ID NO: 18) to produce MRA-IgG1 heavy chain variants, and expression vectors encoding the corresponding genes were produced by a method known to the person skilled in the art. In addition, amino acid residues within the MRA-IgG1 heavy chain constant region (G1T4, SEQ ID NO: 18) were substituted with cysteine to produce variants of the MRA-IgG1 heavy chain constant region shown in Table 14. These variants of the MRA-IgG1 heavy chain constant region were each linked with the MRA-IgG1 heavy chain variable region (MRAH, SEQ ID NO: 17) to produce MRA-IgG1 heavy chain variants, and expression vectors encoding the corresponding genes were produced by a method known to the person skilled in the art.

TABLE 13

| Variant of MRA-IgG1 heavy chain variable region | Position of cysteine substitution (Kabat numbering) | SEQ ID NO: |
|---|---|---|
| MRAH.Q5C | 5 | 322 |
| MRAH.E6C | 6 | 323 |
| MRAH.S7C | 7 | 324 |
| MRAH.G8C | 8 | 325 |
| MRAH.P9C | 9 | 326 |
| MRAH.G10C | 10 | 327 |
| MRAH.L11C | 11 | 328 |
| MRAH.V12C | 12 | 329 |
| MRAH.R13C | 13 | 330 |
| MRAH.P14C | 14 | 331 |
| MRAH.S15C | 15 | 332 |
| MRAH.Q16C | 16 | 333 |
| MRAH.T17C | 17 | 334 |
| MRAH.L18C | 18 | 335 |
| MRAH.S19C | 19 | 336 |
| MRAH.L20C | 20 | 337 |
| MRAH.T21C | 21 | 338 |
| MRAH.T23C | 23 | 339 |
| MRAH.S25C | 25 | 340 |
| MRAH.G26C | 26 | 341 |
| MRAH.S28C | 28 | 342 |
| MRAH.T30C | 30 | 343 |
| MRAH.S31C | 31 | 344 |
| MRAH.W35C | 35 | 345 |
| MRAH.S35aC | 35a | 346 |
| MRAH.Y50C | 50 | 347 |
| MRAH.I51C | 51 | 348 |
| MRAH.S52C | 52 | 349 |
| MRAH.S62C | 62 | 350 |
| MRAH.L63C | 63 | 351 |
| MRAH.K64C | 64 | 352 |
| MRAH.S65C | 65 | 353 |
| MRAH.R66C | 66 | 354 |
| MRAH.V67C | 67 | 355 |
| MRAH.T68C | 68 | 356 |
| MRAH.L70C | 70 | 357 |
| MRAH.D72C | 72 | 358 |
| MRAH.T73C | 73 | 359 |
| MRAH.S74C | 74 | 360 |
| MRAH.K75C | 75 | 361 |
| MRAH.N76C | 76 | 362 |
| MRAH.Q77C | 77 | 363 |
| MRAH.S79C | 79 | 364 |
| MRAH.L80C | 80 | 365 |
| MRAH.R81C | 81 | 366 |
| MRAH.L82C | 82 | 367 |
| MRAH.S82aC | 82a | 368 |
| MRAH.S82bC | 82b | 369 |
| MRAH.V82cC | 82c | 370 |
| MRAH.D101C | 101 | 371 |
| MRAH.Y102C | 102 | 372 |
| MRAH.S112C | 112 | 373 |
| MRAH.S113C | 113 | 374 |

TABLE 14

| Variant of MRA-IgG1 heavy chain constant region | Position of cysteine substitution (EU numbering) | SEQ ID NO: |
|---|---|---|
| G1T4.A118C | 118 | 375 |
| G1T4.S119C | 119 | 376 |
| G1T4.T120C | 120 | 377 |
| G1T4.K121C | 121 | 378 |
| G1T4.G122C | 122 | 379 |
| G1T4.P123C | 123 | 380 |
| G1T4.S124C | 124 | 381 |
| G1T4.V125C | 125 | 382 |
| G1T4.F126C | 126 | 383 |
| G1T4.P127C | 127 | 384 |
| G1T4.S131C | 131 | 385 |
| G1T4.S132C | 132 | 386 |
| G1T4.K133C | 133 | 387 |
| G1T4.S134C | 134 | 388 |
| G1T4.T135C | 135 | 389 |
| G1T4.S136C | 136 | 390 |
| G1T4.G137C | 137 | 391 |
| G1T4.G138C | 138 | 392 |
| G1T4.T139C | 139 | 393 |
| G1T4.A140C | 140 | 394 |
| G1T4.A141C | 141 | 395 |
| G1T4.D148C | 148 | 396 |
| G1T4.Y149C | 149 | 397 |
| G1T4.F150C | 150 | 398 |
| G1T4.P151C | 151 | 399 |
| G1T4.E152C | 152 | 400 |
| G1T4.P153C | 153 | 401 |
| G1T4.V154C | 154 | 402 |
| G1T4.T155C | 155 | 403 |
| G1T4.V156C | 156 | 404 |
| G1T4.S157C | 157 | 405 |
| G1T4.W158C | 158 | 406 |
| G1T4.N159C | 159 | 407 |
| G1T4.S160C | 160 | 408 |
| G1T4.G161C | 161 | 409 |
| G1T4.A162C | 162 | 410 |
| G1T4.L163C | 163 | 411 |
| G1T4.T164C | 164 | 412 |
| G1T4.S165C | 165 | 413 |
| G1T4.G166C | 166 | 414 |
| G1T4.V167C | 167 | 415 |
| G1T4.V173C | 173 | 416 |
| G1T4.L174C | 174 | 417 |
| G1T4.Q175C | 175 | 418 |
| G1T4.S176C | 176 | 419 |
| G1T4.S177C | 177 | 420 |
| G1T4.G178C | 178 | 421 |
| G1T4.L179C | 179 | 422 |
| G1T4.Y180C | 180 | 423 |
| G1T4.V186C | 186 | 424 |
| G1T4.T187C | 187 | 425 |
| G1T4.V188C | 188 | 426 |
| G1T4.P189C | 189 | 427 |
| G1T4.S190C | 190 | 428 |
| G1T4.S191C | 191 | 429 |
| G1T4.S192C | 192 | 430 |
| G1T4.L193C | 193 | 431 |
| G1T4.G194C | 194 | 432 |
| G1T4.T195C | 195 | 433 |
| G1T4.Q196C | 196 | 434 |
| G1T4.T197C | 197 | 435 |
| G1T4.Y198C | 198 | 436 |
| G1T4.I199C | 199 | 437 |
| G1T4.N201C | 201 | 438 |
| G1T4.V202C | 202 | 439 |
| G1T4.N203C | 203 | 440 |
| G1T4.H204C | 204 | 441 |
| G1T4.K205C | 205 | 442 |
| G1T4.P206C | 206 | 443 |
| G1T4.S207C | 207 | 444 |
| G1T4.N208C | 208 | 445 |
| G1T4.T209C | 209 | 446 |
| G1T4.K210C | 210 | 447 |
| G1T4.V211C | 211 | 448 |
| G1T4.D212C | 212 | 449 |
| G1T4.K213C | 213 | 450 |
| G1T4.R214C | 214 | 451 |
| G1T4.V215C | 215 | 452 |
| G1T4.E216C | 216 | 453 |
| G1T4.P217C | 217 | 454 |
| G1T4.K218C | 218 | 455 |
| G1T4.S219C | 219 | 456 |

Similarly, amino acid residues within the MRA-IgG1 light chain variable region (MRAL, SEQ ID NO: 19) were substituted with cysteine to produce variants of the MRA-IgG1 light chain variable region shown in Table 15. These variants of the MRA-IgG1 light chain variable region were each linked with the MRA-IgG1 light chain constant region (k0, SEQ ID NO: 20) to produce MRA-IgG1 light chain variants, and expression vectors encoding the corresponding genes were produced by a method known to the person skilled in the art. In addition, amino acid residues within the MRA-IgG1 light chain constant region (k0, SEQ ID NO: 20) were substituted with cysteine to produce variants of the MRA-IgG1 light chain constant region shown in Table 16. These variants of the MRA-IgG1 heavy chain constant region were each linked with the MRA-IgG1 light chain variable region (MRAL, SEQ ID NO: 19) to produce MRA-IgG1 light chain variants, and expression vectors encoding the corresponding genes were produced by a method known to the person skilled in the art.

TABLE 15

| Variant of MRA-IgG1 light chain variable region | Position of cysteine substitution (Kabat numbering) | SEQ ID NO: |
|---|---|---|
| MRAL.T5C | 5 | 457 |
| MRAL.Q6C | 6 | 458 |
| MRAL.S7C | 7 | 459 |
| MRAL.P8C | 8 | 460 |
| MRAL.S9C | 9 | 461 |
| MRAL.S10C | 10 | 462 |
| MRAL.L11C | 11 | 463 |
| MRAL.S12C | 12 | 464 |
| MRAL.A13C | 13 | 465 |
| MRAL.S14C | 14 | 466 |
| MRAL.V15C | 15 | 467 |
| MRAL.G16C | 16 | 468 |
| MRAL.D17C | 17 | 469 |
| MRAL.R18C | 18 | 470 |
| MRAL.V19C | 19 | 471 |
| MRAL.T20C | 20 | 472 |
| MRAL.I21C | 21 | 473 |
| MRAL.T22C | 22 | 474 |
| MRAL.A25C | 25 | 475 |
| MRAL.S26C | 26 | 476 |
| MRAL.Q27C | 27 | 477 |
| MRAL.Y32C | 32 | 478 |
| MRAL.L33C | 33 | 479 |
| MRAL.N34C | 34 | 480 |
| MRAL.Y50C | 50 | 481 |
| MRAL.T51C | 51 | 482 |
| MRAL.H55C | 55 | 483 |
| MRAL.S56C | 56 | 484 |
| MRAL.G57C | 57 | 485 |
| MRAL.V58C | 58 | 486 |
| MRAL.P59C | 59 | 487 |
| MRAL.S60C | 60 | 488 |
| MRAL.R61C | 61 | 489 |
| MRAL.F62C | 62 | 490 |
| MRAL.S63C | 63 | 491 |
| MRAL.S65C | 65 | 492 |
| MRAL.S67C | 67 | 493 |
| MRAL.G68C | 68 | 494 |
| MRAL.T69C | 69 | 495 |
| MRAL.D70C | 70 | 496 |
| MRAL.T72C | 72 | 497 |
| MRAL.F73C | 73 | 498 |
| MRAL.T74C | 74 | 499 |
| MRAL.I75C | 75 | 500 |
| MRAL.S76C | 76 | 501 |
| MRAL.S77C | 77 | 502 |
| MRAL.L78C | 78 | 503 |
| MRAL.Q79C | 79 | 504 |
| MRAL.Y96C | 96 | 505 |
| MRAL.T97C | 97 | 506 |
| MRAL.F98C | 98 | 507 |
| MRAL.G99C | 99 | 508 |
| MRAL.Q100C | 100 | 509 |
| MRAL.G101C | 101 | 510 |
| MRAL.T102C | 102 | 511 |
| MRAL.K103C | 103 | 512 |
| MRAL.V104C | 104 | 513 |

TABLE 15-continued

| Variant of MRA-IgG1 light chain variable region | Position of cysteine substitution (Kabat numbering) | SEQ ID NO: |
|---|---|---|
| MRAL.E105C | 105 | 514 |
| MRAL.I106C | 106 | 515 |
| MRAL.K107C | 107 | 516 |

TABLE 16

| Variant of MRA-IgG1 light chain constant region | Position of cysteine substitution (Kabat numbering) | SEQ ID NO: |
|---|---|---|
| k0.R108C | 108 | 517 |
| k0.T109C | 109 | 518 |
| k0.V110C | 110 | 519 |
| k0.A111C | 111 | 520 |
| k0.A112C | 112 | 521 |
| k0.P113C | 113 | 522 |
| k0.S114C | 114 | 523 |
| k0.V115C | 115 | 524 |
| k0.F116C | 116 | 525 |
| k0.P120C | 120 | 526 |
| k0.S121C | 121 | 527 |
| k0.D122C | 122 | 528 |
| k0.E123C | 123 | 529 |
| k0.Q124C | 124 | 530 |
| k0.L125C | 125 | 531 |
| k0.K126C | 126 | 532 |
| k0.S127C | 127 | 533 |
| k0.G128C | 128 | 534 |
| k0.T129C | 129 | 535 |
| k0.A130C | 130 | 536 |
| k0.S131C | 131 | 537 |
| k0.L136C | 136 | 538 |
| k0.N137C | 137 | 539 |
| k0.N138C | 138 | 540 |
| k0.F139C | 139 | 541 |
| k0.Y140C | 140 | 542 |
| k0.P141C | 141 | 543 |
| k0.R142C | 142 | 544 |
| k0.E143C | 143 | 545 |
| k0.A144C | 144 | 546 |
| k0.K145C | 145 | 547 |
| k0.V146C | 146 | 548 |
| k0.Q147C | 147 | 549 |
| k0.W148C | 148 | 550 |
| k0.K149C | 149 | 551 |
| k0.V150C | 150 | 552 |
| k0.D151C | 151 | 553 |
| k0.N152C | 152 | 554 |
| k0.A153C | 153 | 555 |
| k0.L154C | 154 | 556 |
| k0.Q155C | 155 | 557 |
| k0.S156C | 156 | 558 |
| k0.G157C | 157 | 559 |
| k0.N158C | 158 | 560 |
| k0.S159C | 159 | 561 |
| k0.Q160C | 160 | 562 |
| k0.E161C | 161 | 563 |
| k0.S162C | 162 | 564 |
| k0.V163C | 163 | 565 |
| k0.T164C | 164 | 566 |
| k0.E165C | 165 | 567 |
| k0.Q166C | 166 | 568 |
| k0.D167C | 167 | 569 |
| k0.S168C | 168 | 570 |
| k0.K169C | 169 | 571 |
| k0.D170C | 170 | 572 |
| k0.S171C | 171 | 573 |
| k0.T172C | 172 | 574 |
| k0.Y173C | 173 | 575 |
| k0.S174C | 174 | 576 |
| k0.L175C | 175 | 577 |
| k0.T180C | 180 | 578 |
| k0.L181C | 181 | 579 |

TABLE 16-continued

| Variant of MRA-IgG1 light chain constant region | Position of cysteine substitution (Kabat numbering) | SEQ ID NO: |
|---|---|---|
| k0.S182C | 182 | 580 |
| k0.K183C | 183 | 581 |
| k0.A184C | 184 | 582 |
| k0.D185C | 185 | 583 |
| k0.Y186C | 186 | 584 |
| k0.E187C | 187 | 585 |
| k0.K188C | 188 | 586 |
| k0.H189C | 189 | 587 |
| k0.K190C | 190 | 588 |
| k0.V191C | 191 | 589 |
| k0.Y192C | 192 | 590 |
| k0.A193C | 193 | 591 |
| k0.E195C | 195 | 592 |
| k0.V196C | 196 | 593 |
| k0.T197C | 197 | 594 |
| k0.H198C | 198 | 595 |
| k0.Q199C | 199 | 596 |
| k0.G200C | 200 | 597 |
| k0.L201C | 201 | 598 |
| k0.S202C | 202 | 599 |
| k0.S203C | 203 | 600 |
| k0.P204C | 204 | 601 |
| k0.V205C | 205 | 602 |
| k0.T206C | 206 | 603 |
| k0.K207C | 207 | 604 |
| k0.S208C | 208 | 605 |
| k0.F209C | 209 | 606 |
| k0.N210C | 210 | 607 |
| k0.R211C | 211 | 608 |
| k0.G212C | 212 | 609 |
| k0.E213C | 213 | 610 |

The MRA-IgG1 heavy chain variants produced above were combined with the MRA-IgG1 light chain, or the MRA-IgG1 heavy chain was combined with the MRA-IgG1 light chain variants. The resultant MRA-IgG1 heavy chain variants and MRA-IgG1 light chain variants shown in Tables 17 and 18 were expressed by transient expression using FreeStyle293 cells (Invitrogen) or Expi293 cells (Life technologies) by a method known to the person skilled in the art, and purified with Protein A by a method known to the person skilled in the art.

TABLE 17

| MRA-IgG1 heavy chain variant name | Heavy chain variable region SEQ ID NO: | Heavy chain constant region SEQ ID NO: | Light chain variable region SEQ ID NO: | Light chain constant region SEQ ID NO: |
|---|---|---|---|---|
| MRAH.Q5C-IgG1 | 322 | 18 | 19 | 20 |
| MRAH.E6C-IgG1 | 323 | 18 | 19 | 20 |
| MRAH.S7C-IgG1 | 324 | 18 | 19 | 20 |
| MRAH.G8C-IgG1 | 325 | 18 | 19 | 20 |
| MRAH.P9C-IgG1 | 326 | 18 | 19 | 20 |
| MRAH.G10C-IgG1 | 327 | 18 | 19 | 20 |
| MRAH.L11C-IgG1 | 328 | 18 | 19 | 20 |
| MRAH.V12C-IgG1 | 329 | 18 | 19 | 20 |
| MRAH.R13C-IgG1 | 330 | 18 | 19 | 20 |
| MRAH.P14C-IgG1 | 331 | 18 | 19 | 20 |
| MRAH.S15C-IgG1 | 332 | 18 | 19 | 20 |
| MRAH.Q16C-IgG1 | 333 | 18 | 19 | 20 |
| MRAH.T17C-IgG1 | 334 | 18 | 19 | 20 |
| MRAH.L18C-IgG1 | 335 | 18 | 19 | 20 |
| MRAH.S19C-IgG1 | 336 | 18 | 19 | 20 |
| MRAH.L20C-IgG1 | 337 | 18 | 19 | 20 |
| MRAH.T21C-IgG1 | 338 | 18 | 19 | 20 |
| MRAH.T23C-IgG1 | 339 | 18 | 19 | 20 |
| MRAH.S25C-IgG1 | 340 | 18 | 19 | 20 |
| MRAH.G26C-IgG1 | 341 | 18 | 19 | 20 |

TABLE 17-continued

| MRA-IgG1 heavy chain variant name | Heavy chain variable region SEQ ID NO: | Heavy chain constant region SEQ ID NO: | Light chain variable region SEQ ID NO: | Light chain constant region SEQ ID NO: |
|---|---|---|---|---|
| MRAH.S28C-IgG1 | 342 | 18 | 19 | 20 |
| MRAH.T30C-IgG1 | 343 | 18 | 19 | 20 |
| MRAH.S31C-IgG1 | 344 | 18 | 19 | 20 |
| MRAH.W35C-IgG1 | 345 | 18 | 19 | 20 |
| MRAH.S35aC-IgG1 | 346 | 18 | 19 | 20 |
| MRAH.Y50C-IgG1 | 347 | 18 | 19 | 20 |
| MRAH.I51C-IgG1 | 348 | 18 | 19 | 20 |
| MRAH.S52C-IgG1 | 349 | 18 | 19 | 20 |
| MRAH.S62C-IgG1 | 350 | 18 | 19 | 20 |
| MRAH.L63C-IgG1 | 351 | 18 | 19 | 20 |
| MRAH.K64C-IgG1 | 352 | 18 | 19 | 20 |
| MRAH.S65C-IgG1 | 353 | 18 | 19 | 20 |
| MRAH.R66C-IgG1 | 354 | 18 | 19 | 20 |
| MRAH.V67C-IgG1 | 355 | 18 | 19 | 20 |
| MRAH.T68C-IgG1 | 356 | 18 | 19 | 20 |
| MRAH.L70C-IgG1 | 357 | 18 | 19 | 20 |
| MRAH.D72C-IgG1 | 358 | 18 | 19 | 20 |
| MRAH.T73C-IgG1 | 359 | 18 | 19 | 20 |
| MRAH.S74C-IgG1 | 360 | 18 | 19 | 20 |
| MRAH.K75C-IgG1 | 361 | 18 | 19 | 20 |
| MRAH.N76C-IgG1 | 362 | 18 | 19 | 20 |
| MRAH.Q77C-IgG1 | 363 | 18 | 19 | 20 |
| MRAH.S79C-IgG1 | 364 | 18 | 19 | 20 |
| MRAH.L80C-IgG1 | 365 | 18 | 19 | 20 |
| MRAH.R81C-IgG1 | 366 | 18 | 19 | 20 |
| MRAH.L82C-IgG1 | 367 | 18 | 19 | 20 |
| MRAH.S82aC-IgG1 | 368 | 18 | 19 | 20 |
| MRAH.S82bC-IgG1 | 369 | 18 | 19 | 20 |
| MRAH.V82cC-IgG1 | 370 | 18 | 19 | 20 |
| MRAH.D101C-IgG1 | 371 | 18 | 19 | 20 |
| MRAH.Y102C-IgG1 | 372 | 18 | 19 | 20 |
| MRAH.S112C-IgG1 | 373 | 18 | 19 | 20 |
| MRAH.S113C-IgG1 | 374 | 18 | 19 | 20 |
| G1T4.A118C-IgG1 | 17 | 375 | 19 | 20 |
| G1T4.S119C-IgG1 | 17 | 376 | 19 | 20 |
| G1T4.T120C-IgG1 | 17 | 377 | 19 | 20 |
| G1T4.K121C-IgG1 | 17 | 378 | 19 | 20 |
| G1T4.G122C-IgG1 | 17 | 379 | 19 | 20 |
| G1T4.P123C-IgG1 | 17 | 380 | 19 | 20 |
| G1T4.S124C-IgG1 | 17 | 381 | 19 | 20 |
| G1T4.V125C-IgG1 | 17 | 382 | 19 | 20 |
| G1T4.F126C-IgG1 | 17 | 383 | 19 | 20 |
| G1T4.P127C-IgG1 | 17 | 384 | 19 | 20 |
| G1T4.S131C-IgG1 | 17 | 385 | 19 | 20 |
| G1T4.S132C-IgG1 | 17 | 386 | 19 | 20 |
| G1T4.K133C-IgG1 | 17 | 387 | 19 | 20 |
| G1T4.S134C-IgG1 | 17 | 388 | 19 | 20 |
| G1T4.T135C-IgG1 | 17 | 389 | 19 | 20 |
| G1T4.S136C-IgG1 | 17 | 390 | 19 | 20 |
| G1T4.G137C-IgG1 | 17 | 391 | 19 | 20 |
| G1T4.G138C-IgG1 | 17 | 392 | 19 | 20 |
| G1T4.T139C-IgG1 | 17 | 393 | 19 | 20 |
| G1T4.A140C-IgG1 | 17 | 394 | 19 | 20 |
| G1T4.A141C-IgG1 | 17 | 395 | 19 | 20 |
| G1T4.D148C-IgG1 | 17 | 396 | 19 | 20 |
| G1T4.Y149C-IgG1 | 17 | 397 | 19 | 20 |
| G1T4.F150C-IgG1 | 17 | 398 | 19 | 20 |
| G1T4.P151C-IgG1 | 17 | 399 | 19 | 20 |
| G1T4.E152C-IgG1 | 17 | 400 | 19 | 20 |
| G1T4.P153C-IgG1 | 17 | 401 | 19 | 20 |
| G1T4.V154C-IgG1 | 17 | 402 | 19 | 20 |
| G1T4.T155C-IgG1 | 17 | 403 | 19 | 20 |
| G1T4.V156C-IgG1 | 17 | 404 | 19 | 20 |
| G1T4.S157C-IgG1 | 17 | 405 | 19 | 20 |
| G1T4.W158C-IgG1 | 17 | 406 | 19 | 20 |
| G1T4.N159C-IgG1 | 17 | 407 | 19 | 20 |
| G1T4.S160C-IgG1 | 17 | 408 | 19 | 20 |
| G1T4.G161C-IgG1 | 17 | 409 | 19 | 20 |
| G1T4.A162C-IgG1 | 17 | 410 | 19 | 20 |
| G1T4.L163C-IgG1 | 17 | 411 | 19 | 20 |
| G1T4.T164C-IgG1 | 17 | 412 | 19 | 20 |
| G1T4.S165C-IgG1 | 17 | 413 | 19 | 20 |
| G1T4.G166C-IgG1 | 17 | 414 | 19 | 20 |

TABLE 17-continued

| MRA-IgG1 heavy chain variant name | Heavy chain variable region SEQ ID NO: | Heavy chain constant region SEQ ID NO: | Light chain variable region SEQ ID NO: | Light chain constant region SEQ ID NO: |
|---|---|---|---|---|
| G1T4.V167C-IgG1 | 17 | 415 | 19 | 20 |
| G1T4.V173C-IgG1 | 17 | 416 | 19 | 20 |
| G1T4.L174C-IgG1 | 17 | 417 | 19 | 20 |
| G1T4.Q175C-IgG1 | 17 | 418 | 19 | 20 |
| G1T4.S176C-IgG1 | 17 | 419 | 19 | 20 |
| G1T4.S177C-IgG1 | 17 | 420 | 19 | 20 |
| G1T4.G178C-IgG1 | 17 | 421 | 19 | 20 |
| G1T4.L179C-IgG1 | 17 | 422 | 19 | 20 |
| G1T4.Y180C-IgG1 | 17 | 423 | 19 | 20 |
| G1T4.V186C-IgG1 | 17 | 424 | 19 | 20 |
| G1T4.T187C-IgG1 | 17 | 425 | 19 | 20 |
| G1T4.V188C-IgG1 | 17 | 426 | 19 | 20 |
| G1T4.P189C-IgG1 | 17 | 427 | 19 | 20 |
| G1T4.S190C-IgG1 | 17 | 428 | 19 | 20 |
| G1T4.S191C-IgG1 | 17 | 429 | 19 | 20 |
| G1T4.S192C-IgG1 | 17 | 430 | 19 | 20 |
| G1T4.L193C-IgG1 | 17 | 431 | 19 | 20 |
| G1T4.G194C-IgG1 | 17 | 432 | 19 | 20 |
| G1T4.T195C-IgG1 | 17 | 433 | 19 | 20 |
| G1T4.Q196C-IgG1 | 17 | 434 | 19 | 20 |
| G1T4.T197C-IgG1 | 17 | 435 | 19 | 20 |
| G1T4.Y198C-IgG1 | 17 | 436 | 19 | 20 |
| G1T4.I199C-IgG1 | 17 | 437 | 19 | 20 |
| G1T4.N201C-IgG1 | 17 | 438 | 19 | 20 |
| G1T4.V202C-IgG1 | 17 | 439 | 19 | 20 |
| G1T4.N203C-IgG1 | 17 | 440 | 19 | 20 |
| G1T4.H204C-IgG1 | 17 | 441 | 19 | 20 |
| G1T4.K205C-IgG1 | 17 | 442 | 19 | 20 |
| G1T4.P206C-IgG1 | 17 | 443 | 19 | 20 |
| G1T4.S207C-IgG1 | 17 | 444 | 19 | 20 |
| G1T4.N208C-IgG1 | 17 | 445 | 19 | 20 |
| G1T4.T209C-IgG1 | 17 | 446 | 19 | 20 |
| G1T4.K210C-IgG1 | 17 | 447 | 19 | 20 |
| G1T4.V211C-IgG1 | 17 | 448 | 19 | 20 |
| G1T4.D212C-IgG1 | 17 | 449 | 19 | 20 |
| G1T4.K213C-IgG1 | 17 | 450 | 19 | 20 |
| G1T4.R214C-IgG1 | 17 | 451 | 19 | 20 |
| G1T4.V215C-IgG1 | 17 | 452 | 19 | 20 |
| G1T4.E216C-IgG1 | 17 | 453 | 19 | 20 |
| G1T4.P217C-IgG1 | 17 | 454 | 19 | 20 |
| G1T4.K218C-IgG1 | 17 | 455 | 19 | 20 |
| G1T4.S219C-IgG1 | 17 | 456 | 19 | 20 |

TABLE 18

| MRA-IgG1 light chain variant name | Heavy chain variable region SEQ ID NO: | Heavy chain constant region SEQ ID NO: | Light chain variable region SEQ ID NO: | Light chain constant region SEQ ID NO: |
|---|---|---|---|---|
| MRAL.T5C-IgG1 | 17 | 18 | 457 | 20 |
| MRAL.Q6C-IgG1 | 17 | 18 | 458 | 20 |
| MRAL.S7C-IgG1 | 17 | 18 | 459 | 20 |
| MRAL.P8C-IgG1 | 17 | 18 | 460 | 20 |
| MRAL.S9C-IgG1 | 17 | 18 | 461 | 20 |
| MRAL.S10C-IgG1 | 17 | 18 | 462 | 20 |
| MRAL.L11C-IgG1 | 17 | 18 | 463 | 20 |
| MRAL.S12C-IgG1 | 17 | 18 | 464 | 20 |
| MRAL.A13C-IgG1 | 17 | 18 | 465 | 20 |
| MRAL.S14C-IgG1 | 17 | 18 | 466 | 20 |
| MRAL.V15C-IgG1 | 17 | 18 | 467 | 20 |
| MRAL.G16C-IgG1 | 17 | 18 | 468 | 20 |
| MRAL.D17C-IgG1 | 17 | 18 | 469 | 20 |
| MRAL.R18C-IgG1 | 17 | 18 | 470 | 20 |
| MRAL.V19C-IgG1 | 17 | 18 | 471 | 20 |
| MRAL.T20C-IgG1 | 17 | 18 | 472 | 20 |
| MRAL.I21C-IgG1 | 17 | 18 | 473 | 20 |
| MRAL.T22C-IgG1 | 17 | 18 | 474 | 20 |

TABLE 18-continued

| MRA-IgG1 light chain variant name | Heavy chain variable region SEQ ID NO: | Heavy chain constant region SEQ ID NO: | Light chain variable region SEQ ID NO: | Light chain constant region SEQ ID NO: |
|---|---|---|---|---|
| MRAL.A25C-IgG1 | 17 | 18 | 475 | 20 |
| MRAL.S26C-IgG1 | 17 | 18 | 476 | 20 |
| MRAL.Q27C-IgG1 | 17 | 18 | 477 | 20 |
| MRAL.Y32C-IgG1 | 17 | 18 | 478 | 20 |
| MRAL.L33C-IgG1 | 17 | 18 | 479 | 20 |
| MRAL.N34C-IgG1 | 17 | 18 | 480 | 20 |
| MRAL.Y50C-IgG1 | 17 | 18 | 481 | 20 |
| MRAL.T51C-IgG1 | 17 | 18 | 482 | 20 |
| MRAL.H55C-IgG1 | 17 | 18 | 483 | 20 |
| MRAL.S56C-IgG1 | 17 | 18 | 484 | 20 |
| MRAL.G57C-IgG1 | 17 | 18 | 485 | 20 |
| MRAL.V58C-IgG1 | 17 | 18 | 486 | 20 |
| MRAL.P59C-IgG1 | 17 | 18 | 487 | 20 |
| MRAL.S60C-IgG1 | 17 | 18 | 488 | 20 |
| MRAL.R61C-IgG1 | 17 | 18 | 489 | 20 |
| MRAL.F62C-IgG1 | 17 | 18 | 490 | 20 |
| MRAL.S63C-IgG1 | 17 | 18 | 491 | 20 |
| MRAL.S65C-IgG1 | 17 | 18 | 492 | 20 |
| MRAL.S67C-IgG1 | 17 | 18 | 493 | 20 |
| MRAL.G68C-IgG1 | 17 | 18 | 494 | 20 |
| MRAL.T69C-IgG1 | 17 | 18 | 495 | 20 |
| MRAL.D70C-IgG1 | 17 | 18 | 496 | 20 |
| MRAL.T72C-IgG1 | 17 | 18 | 497 | 20 |
| MRAL.F73C-IgG1 | 17 | 18 | 498 | 20 |
| MRAL.T74C-IgG1 | 17 | 18 | 499 | 20 |
| MRAL.I75C-IgG1 | 17 | 18 | 500 | 20 |
| MRAL.S76C-IgG1 | 17 | 18 | 501 | 20 |
| MRAL.S77C-IgG1 | 17 | 18 | 502 | 20 |
| MRAL.L78C-IgG1 | 17 | 18 | 503 | 20 |
| MRAL.Q79C-IgG1 | 17 | 18 | 504 | 20 |
| MRAL.Y96C-IgG1 | 17 | 18 | 505 | 20 |
| MRAL.T97C-IgG1 | 17 | 18 | 506 | 20 |
| MRAL.F98C-IgG1 | 17 | 18 | 507 | 20 |
| MRAL.G99C-IgG1 | 17 | 18 | 508 | 20 |
| MRAL.Q100C-IgG1 | 17 | 18 | 509 | 20 |
| MRAL.G101C-IgG1 | 17 | 18 | 510 | 20 |
| MRAL.T102C-IgG1 | 17 | 18 | 511 | 20 |
| MRAL.K103C-IgG1 | 17 | 18 | 512 | 20 |
| MRAL.V104C-IgG1 | 17 | 18 | 513 | 20 |
| MRAL.E105C-IgG1 | 17 | 18 | 514 | 20 |
| MRAL.I106C-IgG1 | 17 | 18 | 515 | 20 |
| MRAL.K107C-IgG1 | 17 | 18 | 516 | 20 |
| k0.R108C-IgG1 | 17 | 18 | 19 | 517 |
| k0.T109C-IgG1 | 17 | 18 | 19 | 518 |
| k0.V110C-IgG1 | 17 | 18 | 19 | 519 |
| k0.A111C-IgG1 | 17 | 18 | 19 | 520 |
| k0.A112C-IgG1 | 17 | 18 | 19 | 521 |
| k0.P113C-IgG1 | 17 | 18 | 19 | 522 |
| k0.S114C-IgG1 | 17 | 18 | 19 | 523 |
| k0.V115C-IgG1 | 17 | 18 | 19 | 524 |
| k0.F116C-IgG1 | 17 | 18 | 19 | 525 |
| k0.P120C-IgG1 | 17 | 18 | 19 | 526 |
| k0.S121C-IgG1 | 17 | 18 | 19 | 527 |
| k0.D122C-IgG1 | 17 | 18 | 19 | 528 |
| k0.E123C-IgG1 | 17 | 18 | 19 | 529 |
| k0.Q124C-IgG1 | 17 | 18 | 19 | 530 |
| k0.L125C-IgG1 | 17 | 18 | 19 | 531 |
| k0.K126C-IgG1 | 17 | 18 | 19 | 532 |
| k0.S127C-IgG1 | 17 | 18 | 19 | 533 |
| k0.G128C-IgG1 | 17 | 18 | 19 | 534 |
| k0.T129C-IgG1 | 17 | 18 | 19 | 535 |
| k0.A130C-IgG1 | 17 | 18 | 19 | 536 |
| k0.S131C-IgG1 | 17 | 18 | 19 | 537 |
| k0.L136C-IgG1 | 17 | 18 | 19 | 538 |
| k0.N137C-IgG1 | 17 | 18 | 19 | 539 |
| k0.N138C-IgG1 | 17 | 18 | 19 | 540 |
| k0.F139C-IgG1 | 17 | 18 | 19 | 541 |
| k0.Y140C-IgG1 | 17 | 18 | 19 | 542 |
| k0.P141C-IgG1 | 17 | 18 | 19 | 543 |
| k0.R142C-IgG1 | 17 | 18 | 19 | 544 |
| k0.E143C-IgG1 | 17 | 18 | 19 | 545 |
| k0.A144C-IgG1 | 17 | 18 | 19 | 546 |
| k0.K145C-IgG1 | 17 | 18 | 19 | 547 |

TABLE 18-continued

| MRA-IgG1 light chain variant name | Heavy chain variable region SEQ ID NO: | Heavy chain constant region SEQ ID NO: | Light chain variable region SEQ ID NO: | Light chain constant region SEQ ID NO: |
|---|---|---|---|---|
| k0.V146C-IgG1 | 17 | 18 | 19 | 548 |
| k0.Q147C-IgG1 | 17 | 18 | 19 | 549 |
| k0.W148C-IgG1 | 17 | 18 | 19 | 550 |
| k0.K149C-IgG1 | 17 | 18 | 19 | 551 |
| k0.V150C-IgG1 | 17 | 18 | 19 | 552 |
| k0.D151C-IgG1 | 17 | 18 | 19 | 553 |
| k0.N152C-IgG1 | 17 | 18 | 19 | 554 |
| k0.A153C-IgG1 | 17 | 18 | 19 | 555 |
| k0.L154C-IgG1 | 17 | 18 | 19 | 556 |
| k0.Q155C-IgG1 | 17 | 18 | 19 | 557 |
| k0.S156C-IgG1 | 17 | 18 | 19 | 558 |
| k0.G157C-IgG1 | 17 | 18 | 19 | 559 |
| k0.N158C-IgG1 | 17 | 18 | 19 | 560 |
| k0.S159C-IgG1 | 17 | 18 | 19 | 561 |
| k0.Q160C-IgG1 | 17 | 18 | 19 | 562 |
| k0.E161C-IgG1 | 17 | 18 | 19 | 563 |
| k0.S162C-IgG1 | 17 | 18 | 19 | 564 |
| k0.V163C-IgG1 | 17 | 18 | 19 | 565 |
| k0.T164C-IgG1 | 17 | 18 | 19 | 566 |
| k0.E165C-IgG1 | 17 | 18 | 19 | 567 |
| k0.Q166C-IgG1 | 17 | 18 | 19 | 568 |
| k0.D167C-IgG1 | 17 | 18 | 19 | 569 |
| k0.S168C-IgG1 | 17 | 18 | 19 | 570 |
| k0.K169C-IgG1 | 17 | 18 | 19 | 571 |
| k0.D170C-IgG1 | 17 | 18 | 19 | 572 |
| k0.S171C-IgG1 | 17 | 18 | 19 | 573 |
| k0.T172C-IgG1 | 17 | 18 | 19 | 574 |
| k0.Y173C-IgG1 | 17 | 18 | 19 | 575 |
| k0.S174C-IgG1 | 17 | 18 | 19 | 576 |
| k0.L175C-IgG1 | 17 | 18 | 19 | 577 |
| k0.T180C-IgG1 | 17 | 18 | 19 | 578 |
| k0.L181C-IgG1 | 17 | 18 | 19 | 579 |
| k0.S182C-IgG1 | 17 | 18 | 19 | 580 |
| k0.K183C-IgG1 | 17 | 18 | 19 | 581 |
| k0.A184C-IgG1 | 17 | 18 | 19 | 582 |
| k0.D185C-IgG1 | 17 | 18 | 19 | 583 |
| k0.Y186C-IgG1 | 17 | 18 | 19 | 584 |
| k0.E187C-IgG1 | 17 | 18 | 19 | 585 |
| k0.K188C-IgG1 | 17 | 18 | 19 | 586 |
| k0.H189C-IgG1 | 17 | 18 | 19 | 587 |
| k0.K190C-IgG1 | 17 | 18 | 19 | 588 |
| k0.V191C-IgG1 | 17 | 18 | 19 | 589 |
| k0.Y192C-IgG1 | 17 | 18 | 19 | 590 |
| k0.A193C-IgG1 | 17 | 18 | 19 | 591 |
| k0.E195C-IgG1 | 17 | 18 | 19 | 592 |
| k0.V196C-IgG1 | 17 | 18 | 19 | 593 |
| k0.T197C-IgG1 | 17 | 18 | 19 | 594 |
| k0.H198C-IgG1 | 17 | 18 | 19 | 595 |
| k0.Q199C-IgG1 | 17 | 18 | 19 | 596 |
| k0.G200C-IgG1 | 17 | 18 | 19 | 597 |
| k0.L201C-IgG1 | 17 | 18 | 19 | 598 |
| k0.S202C-IgG1 | 17 | 18 | 19 | 599 |
| k0.S203C-IgG1 | 17 | 18 | 19 | 600 |
| k0.P204C-IgG1 | 17 | 18 | 19 | 601 |
| k0.V205C-IgG1 | 17 | 18 | 19 | 602 |
| k0.T206C-IgG1 | 17 | 18 | 19 | 603 |
| k0.K207C-IgG1 | 17 | 18 | 19 | 604 |
| k0.S208C-IgG1 | 17 | 18 | 19 | 605 |
| k0.F209C-IgG1 | 17 | 18 | 19 | 606 |
| k0.N210C-IgG1 | 17 | 18 | 19 | 607 |
| k0.R211C-IgG1 | 17 | 18 | 19 | 608 |
| k0.G212C-IgG1 | 17 | 18 | 19 | 609 |
| k0.E213C-IgG1 | 17 | 18 | 19 | 610 |

Example 8-2 Assessment of Electrophoretic Mobility in Polyacrylamide Gel of Antibodies Having Cysteine Substitution at Various Positions of IgG1

It was examined with non-reducing SDS-PAGE whether the MRA-IgG1 variants produced in Example 8-1 show a different electrophoretic mobility to MRA-IgG1. Sample Buffer Solution (2ME-) (×4) (Wako; 198-13282) was used for preparing electrophoresis samples, the samples were treated for 10 minutes under the condition of specimen concentration 50 µg/mL and 70° C., and then subjected to non-reducing SDS-PAGE. In non-reducing SDS-PAGE, electrophoresis was carried out for 90 minutes at 125 V, using 4% SDS-PAGE mini 15 well 1.0 mm 15 well (TEFCO; Cat #01-052-6). Then, the gel was stained with CBB stain, the gel image was captured with ChemiDoc-TouchMP (BIORAD), and the bands were quantified with Image Lab (BIORAD).

From the obtained gel image, the variants were classified into 7 groups according to the band pattern of each of the MRA-IgG1 variants: Single (one band at a molecular weight region similar to that of MRA-IgG1), Double (two bands at a molecular weight region similar to that of MRA-IgG1), Triple (three bands at a molecular weight region similar to that of MRA-IgG1), Several (four or more bands at a molecular weight region similar to that of MRA-IgG1), LMW (band(s) at a molecular weight region lower than that of MRA-IgG1), HMW (band(s) at a molecular weight region higher than that of MRA-IgG1), and Faint (band(s) blurry and difficult to determine). Regarding the MRA-IgG1 variants classified as "Double", one of the two bands showed the same electrophoretic mobility as MRA-IgG1 while the other band showed slightly faster or slower mobility. Thus, for the MRA-IgG1 variants classified as "Double", the percentage of the bands showing different mobility to MRA-IgG1 (percentage of new band (%)) was also calculated. Grouping of the band patterns for MRA-IgG1 heavy chain variants and MRA-IgG1 light chain variants, and the calculation results of the band percentage are respectively shown in Tables 19 and 20. From Tables 19 and 20, variants classified into the Double and Triple groups are shown in Table 21. In these variants, it is highly likely that cysteine substitution caused structural changes such as crosslinkage of Fabs, which resulted in the change in electrophoretic mobility. It is noted that while Table 20 indicates "no data" for MRAL.K107C-IgG1, position 107 (Kabat numbering), which is the position of cysteine substitution in this variant, is a position where the residue structurally exposed to the surface is present in the hinge region. Thus, in this variant also, it is highly likely that cysteine substitution causes structural changes such as crosslinkage of Fabs, and results in the change in electrophoretic mobility.

TABLE 19

| MRA-IgG1 heavy chain variant name | Group | Percentage of new band (%) |
|---|---|---|
| MRAH.Q5C-IgG1 | Single | — |
| MRAH.E6C-IgG1 | Double | 30.7 |
| MRAH.S7C-IgG1 | Single | — |
| MRAH.G8C-IgG1 | Single | — |
| MRAH.P9C-IgG1 | Single | — |
| MRAH.G10C-IgG1 | Single | — |
| MRAH.L11C-IgG1 | Single | — |
| MRAH.V12C-IgG1 | Single | — |
| MRAH.R13C-IgG1 | Single | — |
| MRAH.P14C-IgG1 | Single | — |
| MRAH.S15C-IgG1 | Single | — |
| MRAH.Q16C-IgG1 | Single | — |
| MRAH.T17C-IgG1 | Single | — |
| MRAH.L18C-IgG1 | Faint | — |
| MRAH.S19C-IgG1 | Single | — |
| MRAH.L20C-IgG1 | Faint | — |
| MRAH.T21C-IgG1 | Single | — |
| MRAH.T23C-IgG1 | no data | — |

TABLE 19-continued

| MRA-IgG1 heavy chain variant name | Group | Percentage of new band (%) |
|---|---|---|
| MRAH.S25C-IgG1 | Double | 20.2 |
| MRAH.G26C-IgG1 | Double | 14.5 |
| MRAH.S28C-IgG1 | Single | — |
| MRAH.T30C-IgG1 | Single | — |
| MRAH.S31C-IgG1 | Single | — |
| MRAH.W35C-IgG1 | Faint | — |
| MRAH.S35aC-IgG1 | Faint | — |
| MRAH.Y50C-IgG1 | Single | — |
| MRAH.I51C-IgG1 | Faint | — |
| MRAH.S52C-IgG1 | Single | — |
| MRAH.S62C-IgG1 | Single | — |
| MRAH.L63C-IgG1 | Single | — |
| MRAH.K64C-IgG1 | Single | — |
| MRAH.S65C-IgG1 | Single | — |
| MRAH.R66C-IgG1 | Single | — |
| MRAH.V67C-IgG1 | Single | — |
| MRAH.T68C-IgG1 | Single | — |
| MRAH.L70C-IgG1 | no data | — |
| MRAH.D72C-IgG1 | Single | — |
| MRAH.T73C-IgG1 | Single | — |
| MRAH.S74C-IgG1 | Single | — |
| MRAH.K75C-IgG1 | Single | — |
| MRAH.N76C-IgG1 | Single | — |
| MRAH.Q77C-IgG1 | Single | — |
| MRAH.S79C-IgG1 | Single | — |
| MRAH.L80C-IgG1 | Faint | — |
| MRAH.R81C-IgG1 | Single | — |
| MRAH.L82C-IgG1 | Faint | — |
| MRAH.S82aC-IgG1 | Single | — |
| MRAH.S82bC-IgG1 | Single | — |
| MRAH.V82cC-IgG1 | Faint | — |
| MRAH.D101C-IgG1 | Single | — |
| MRAH.Y102C-IgG1 | Single | — |
| MRAH.S112C-IgG1 | Single | — |
| MRAH.S113C-IgG1 | Single | — |
| G1T4.A118C-IgG1 | Single | — |
| G1T4.S119C-IgG1 | Double | 18.4 |
| G1T4.T120C-IgG1 | Single | — |
| G1T4.K121C-IgG1 | Single | — |
| G1T4.G122C-IgG1 | Single | — |
| G1T4.P123C-IgG1 | LMW | — |
| G1T4.S124C-IgG1 | Single | — |
| G1T4.V125C-IgG1 | LMW | — |
| G1T4.F126C-IgG1 | Single | — |
| G1T4.P127C-IgG1 | LMW | — |
| G1T4.S131C-IgG1 | Triple | — |
| G1T4.S132C-IgG1 | Triple | — |
| G1T4.K133C-IgG1 | Triple | — |
| G1T4.S134C-IgG1 | Triple | — |
| G1T4.T135C-IgG1 | Triple | — |
| G1T4.S136C-IgG1 | Triple | — |
| G1T4.G137C-IgG1 | Triple | — |
| G1T4.G138C-IgG1 | Double | 56.7 |
| G1T4.T139C-IgG1 | Single | — |
| G1T4.A140C-IgG1 | Single | — |
| G1T4.A141C-IgG1 | Faint | — |
| G1T4.D148C-IgG1 | Single | — |
| G1T4.Y149C-IgG1 | Faint | — |
| G1T4.F150C-IgG1 | Single | — |
| G1T4.P151C-IgG1 | Faint | — |
| G1T4.E152C-IgG1 | Single | — |
| G1T4.P153C-IgG1 | Single | — |
| G1T4.V154C-IgG1 | LMW | — |
| G1T4.T155C-IgG1 | Single | — |
| G1T4.V156C-IgG1 | LMW | — |
| G1T4.S157C-IgG1 | Single | — |
| G1T4.W158C-IgG1 | LMW | — |
| G1T4.N159C-IgG1 | Double | 24 |
| G1T4.S160C-IgG1 | Double | 35.7 |
| G1T4.G161C-IgG1 | Double | 27.2 |
| G1T4.A162C-IgG1 | Double | 27.8 |
| G1T4.L163C-IgG1 | Double | 16.7 |
| G1T4.T164C-IgG1 | Double | 13.8 |
| G1T4.S165C-IgG1 | Single | — |
| G1T4.G166C-IgG1 | Single | — |
| G1T4.V167C-IgG1 | Single | — |
| G1T4.V173C-IgG1 | Single | — |
| G1T4.L174C-IgG1 | Single | — |
| G1T4.Q175C-IgG1 | Single | — |
| G1T4.S176C-IgG1 | Single | — |
| G1T4.S177C-IgG1 | Single | — |
| G1T4.G178C-IgG1 | Single | — |
| G1T4.L179C-IgG1 | Single | — |
| G1T4.Y180C-IgG1 | LMW | — |
| G1T4.V186C-IgG1 | LMW | — |
| G1T4.T187C-IgG1 | Single | — |
| G1T4.V188C-IgG1 | LMW | — |
| G1T4.P189C-IgG1 | no data | — |
| G1T4.S190C-IgG1 | Double | 31.8 |
| G1T4.S191C-IgG1 | Double | 66.3 |
| G1T4.S192C-IgG1 | Double | 26.8 |
| G1T4.L193C-IgG1 | LMW | — |
| G1T4.G194C-IgG1 | Faint | — |
| G1T4.T195C-IgG1 | Double | 78.1 |
| G1T4.Q196C-IgG1 | Double | 27.4 |
| G1T4.T197C-IgG1 | Double | 84.4 |
| G1T4.Y198C-IgG1 | Faint | — |
| G1T4.I199C-IgG1 | Single | — |
| G1T4.N201C-IgG1 | Double | 17.5 |
| G1T4.V202C-IgG1 | LMW | — |
| G1T4.N203C-IgG1 | Double | 17.2 |
| G1T4.H204C-IgG1 | Faint | — |
| G1T4.K205C-IgG1 | Double | 18.4 |
| G1T4.P206C-IgG1 | Double | 14.4 |
| G1T4.S207C-IgG1 | Double | 21.5 |
| G1T4.N208C-IgG1 | Double | 16.1 |
| G1T4.T209C-IgG1 | Single | — |
| G1T4.K210C-IgG1 | Single | — |
| G1T4.V211C-IgG1 | Double | 27.2 |
| G1T4.D212C-IgG1 | Double | 28.2 |
| G1T4.K213C-IgG1 | LMW | — |
| G1T4.R214C-IgG1 | LMW | — |
| G1T4.V215C-IgG1 | LMW | — |
| G1T4.E216C-IgG1 | LMW | — |
| G1T4.P217C-IgG1 | LMW | — |
| G1T4.K218C-IgG1 | Double | 39.3 |
| G1T4.S219C-IgG1 | Double | 68.7 |

TABLE 20

| MRA-IgG1 light chain variant name | Group | Percentage of new band (%) |
|---|---|---|
| MRAL.T5C-IgG1 | Single | — |
| MRAL.Q6C-IgG1 | LMW | — |
| MRAL.S7C-IgG1 | Single | — |
| MRAL.P8C-IgG1 | no data | — |
| MRAL.S9C-IgG1 | Single | — |
| MRAL.S10C-IgG1 | Single | — |
| MRAL.L11C-IgG1 | Single | — |
| MRAL.S12C-IgG1 | Single | — |
| MRAL.A13C-IgG1 | Single | — |
| MRAL.S14C-IgG1 | Single | — |
| MRAL.V15C-IgG1 | Single | — |
| MRAL.G16C-IgG1 | Single | — |
| MRAL.D17C-IgG1 | Single | — |
| MRAL.R18C-IgG1 | Single | — |
| MRAL.V19C-IgG1 | LMW | — |
| MRAL.T20C-IgG1 | Single | — |
| MRAL.I21C-IgG1 | Double | 68.9 |
| MRAL.T22C-IgG1 | Single | — |
| MRAL.A25C-IgG1 | no data | — |
| MRAL.S26C-IgG1 | no data | — |
| MRAL.Q27C-IgG1 | Triple | — |
| MRAL.Y32C-IgG1 | Single | — |
| MRAL.L33C-IgG1 | LMW | — |
| MRAL.N34C-IgG1 | LMW | — |
| MRAL.Y50C-IgG1 | Single | — |
| MRAL.T51C-IgG1 | Single | — |
| MRAL.H55C-IgG1 | Single | — |
| MRAL.S56C-IgG1 | Single | — |

TABLE 20-continued

| MRA-IgG1 light chain variant name | Group | Percentage of new band (%) |
|---|---|---|
| MRAL.G57C-IgG1 | Single | — |
| MRAL.V58C-IgG1 | Double | 17.4 |
| MRAL.P59C-IgG1 | Single | — |
| MRAL.S60C-IgG1 | Single | — |
| MRAL.R61C-IgG1 | Single | — |
| MRAL.F62C-IgG1 | LMW | — |
| MRAL.S63C-IgG1 | Single | — |
| MRAL.S65C-IgG1 | Single | — |
| MRAL.S67C-IgG1 | Single | — |
| MRAL.G68C-IgG1 | Single | — |
| MRAL.T69C-IgG1 | Single | — |
| MRAL.D70C-IgG1 | Single | — |
| MRAL.T72C-IgG1 | Single | — |
| MRAL.F73C-IgG1 | LMW | — |
| MRAL.T74C-IgG1 | Single | — |
| MRAL.I75C-IgG1 | no data | — |
| MRAL.S76C-IgG1 | Single | — |
| MRAL.S77C-IgG1 | Double | 18.1 |
| MRAL.L78C-IgG1 | LMW | — |
| MRAL.Q79C-IgG1 | Single | — |
| MRAL.Y96C-IgG1 | LMW | — |
| MRAL.T97C-IgG1 | Single | — |
| MRAL.F98C-IgG1 | LMW | — |
| MRAL.G99C-IgG1 | no data | — |
| MRAL.Q100C-IgG1 | Single | — |
| MRAL.G101C-IgG1 | Single | — |
| MRAL.T102C-IgG1 | LMW | — |
| MRAL.K103C-IgG1 | Single | — |
| MRAL.V104C-IgG1 | LMW | — |
| MRAL.E105C-IgG1 | no data | — |
| MRAL.I106C-IgG1 | Single | — |
| MRAL.K107C-IgG1 | no data | — |
| k0.R108C-IgG1 | Single | — |
| k0.T109C-IgG1 | Double | 23.1 |
| k0.V110C-IgG1 | Single | — |
| k0.A111C-IgG1 | Single | — |
| k0.A112C-IgG1 | Double | 21.6 |
| k0.P113C-IgG1 | Single | — |
| k0.S114C-IgG1 | Single | — |
| k0.V115C-IgG1 | LMW | — |
| k0.F116C-IgG1 | Single | — |
| k0.P120C-IgG1 | LMW | — |
| k0.S121C-IgG1 | Several | — |
| k0.D122C-IgG1 | LMW | — |
| k0.E123C-IgG1 | Double | 18.1 |
| k0.Q124C-IgG1 | LMW | — |
| k0.L125C-IgG1 | LMW | — |
| k0.K126C-IgG1 | Triple | — |
| k0.S127C-IgG1 | Single | — |
| k0.G128C-IgG1 | Double | 19.4 |
| k0.T129C-IgG1 | Single | — |
| k0.A130C-IgG1 | LMW | — |
| k0.S131C-IgG1 | LMW | — |
| k0.L136C-IgG1 | LMW | — |
| k0.N137C-IgG1 | LMW | — |
| k0.N138C-IgG1 | Single | — |
| k0.F139C-IgG1 | LMW | — |
| k0.Y140C-IgG1 | LMW | — |
| k0.P141C-IgG1 | Single | — |
| k0.R142C-IgG1 | Single | — |
| k0.E143C-IgG1 | Single | — |
| k0.A144C-IgG1 | LMW | — |
| k0.K145C-IgG1 | Single | — |
| k0.V146C-IgG1 | LMW | — |
| k0.Q147C-IgG1 | Single | — |
| k0.W148C-IgG1 | LMW | — |
| k0.K149C-IgG1 | Single | — |
| k0.V150C-IgG1 | LMW | — |
| k0.D151C-IgG1 | Single | — |
| k0.N152C-IgG1 | Double | 62.4 |
| k0.A153C-IgG1 | Single | — |
| k0.L154C-IgG1 | Single | — |
| k0.Q155C-IgG1 | Single | — |
| k0.S156C-IgG1 | HMW | — |
| k0.G157C-IgG1 | Single | — |
| k0.N158C-IgG1 | Single | — |
| k0.S159C-IgG1 | Single | — |
| k0.Q160C-IgG1 | Single | — |
| k0.E161C-IgG1 | Single | — |
| k0.S162C-IgG1 | Single | — |
| k0.V163C-IgG1 | Single | — |
| k0.T164C-IgG1 | Single | — |
| k0.E165C-IgG1 | Single | — |
| k0.Q166C-IgG1 | Single | — |
| k0.D167C-IgG1 | Single | — |
| k0.S168C-IgG1 | Single | — |
| k0.K169C-IgG1 | Single | — |
| k0.D170C-IgG1 | Single | — |
| k0.S171C-IgG1 | Single | — |
| k0.T172C-IgG1 | LMW | — |
| k0.Y173C-IgG1 | LMW | — |
| k0.S174C-IgG1 | Single | — |
| k0.L175C-IgG1 | LMW | — |
| k0.T180C-IgG1 | Single | — |
| k0.L181C-IgG1 | Single | — |
| k0.S182C-IgG1 | Single | — |
| k0.K183C-IgG1 | Single | — |
| k0.A184C-IgG1 | Single | — |
| k0.D185C-IgG1 | Single | — |
| k0.Y186C-IgG1 | Double | 26.3 |
| k0.E187C-IgG1 | LMW | — |
| k0.K188C-IgG1 | Single | — |
| k0.H189C-IgG1 | Triple | — |
| k0.K190C-IgG1 | LMW | — |
| k0.V191C-IgG1 | LMW | — |
| k0.Y192C-IgG1 | Single | — |
| k0.A193C-IgG1 | Single | — |
| k0.E195C-IgG1 | Single | — |
| k0.V196C-IgG1 | Single | — |
| k0.T197C-IgG1 | Single | — |
| k0.H198C-IgG1 | Faint | — |
| k0.Q199C-IgG1 | Single | — |
| k0.G200C-IgG1 | Double | 18.7 |
| k0.L201C-IgG1 | Single | — |
| k0.S202C-IgG1 | Double | 42.3 |
| k0.S203C-IgG1 | Double | 45.5 |
| k0.P204C-IgG1 | Single | — |
| k0.V205C-IgG1 | Single | — |
| k0.T206C-IgG1 | Single | — |
| k0.K207C-IgG1 | Single | — |
| k0.S208C-IgG1 | Single | — |
| k0.F209C-IgG1 | LMW | — |
| k0.N210C-IgG1 | LMW | — |
| k0.R211C-IgG1 | Single | — |
| k0.G212C-IgG1 | Double | 68.5 |
| k0.E213C-IgG1 | LMW | — |

TABLE 21

| MRA-IgG1 variant name | Group | Percentage of new band (%) |
|---|---|---|
| MRAH.E6C-IgG1 | Double | 30.7 |
| MRAH.S25C-IgG1 | Double | 20.2 |
| MRAH.G26C-IgG1 | Double | 14.5 |
| G1T4.S119C-IgG1 | Double | 18.4 |
| G1T4.S131C-IgG1 | Triple | — |
| G1T4.S132C-IgG1 | Triple | — |
| G1T4.K133C-IgG1 | Triple | — |
| G1T4.S134C-IgG1 | Triple | — |
| G1T4.T135C-IgG1 | Triple | — |
| G1T4.S136C-IgG1 | Triple | — |
| G1T4.G137C-IgG1 | Triple | — |
| G1T4.G138C-IgG1 | Double | 56.7 |
| G1T4.N159C-IgG1 | Double | 24 |
| G1T4.S160C-IgG1 | Double | 35.7 |
| G1T4.G161C-IgG1 | Double | 27.2 |
| G1T4.A162C-IgG1 | Double | 27.8 |
| G1T4.L163C-IgG1 | Double | 16.7 |
| G1T4.T164C-IgG1 | Double | 13.8 |
| G1T4.S190C-IgG1 | Double | 31.8 |

TABLE 21-continued

| MRA-IgG1 variant name | Group | Percentage of new band (%) |
|---|---|---|
| G1T4.S191C-IgG1 | Double | 66.3 |
| G1T4.S192C-IgG1 | Double | 26.8 |
| G1T4.T195C-IgG1 | Double | 78.1 |
| G1T4.Q196C-IgG1 | Double | 27.4 |
| G1T4.T197C-IgG1 | Double | 84.4 |
| G1T4.N201C-IgG1 | Double | 17.5 |
| G1T4.N203C-IgG1 | Double | 17.2 |
| G1T4.K205C-IgG1 | Double | 18.4 |
| G1T4.P206C-IgG1 | Double | 14.4 |
| G1T4.S207C-IgG1 | Double | 21.5 |
| G1T4.N208C-IgG1 | Double | 16.1 |
| G1T4.V211C-IgG1 | Double | 27.2 |
| G1T4.D212C-IgG1 | Double | 28.2 |
| G1T4.K218C-IgG1 | Double | 39.3 |
| G1T4.S219C-IgG1 | Double | 68.7 |
| MRAL.I21C-IgG1 | Double | 68.9 |
| MRAL.Q27C-IgG1 | Triple | — |
| MRAL.V58C-IgG1 | Double | 17.4 |
| MRAL.S77C-IgG1 | Double | 18.1 |
| k0.T109C-IgG1 | Double | 23.1 |
| k0.A112C-IgG1 | Double | 21.6 |
| k0.E123C-IgG1 | Double | 18.1 |
| k0.K126C-IgG1 | Triple | — |
| k0.G128C-IgG1 | Double | 19.4 |
| Maka | Double | 62.4 |
| k0.Y186C-IgG1 | Double | 26.3 |
| k0.H189C-IgG1 | Triple | — |
| k0.G200C-IgG1 | Double | 18.7 |
| k0.S202C-IgG1 | Double | 42.3 |
| k0.S203C-IgG1 | Double | 45.5 |
| k0.G212C-IgG1 | Double | 68.5 |

Example 9 Assessment of Antibodies Having Cysteine Substitution at Various Positions of IgG4

Example 9-1 Production of Antibodies Having Cysteine Substitution at Various Positions of IgG4

The heavy chain and light chain of an anti-human IL6R neutralizing antibody, MRA-IgG4 (heavy chain: MRAH-G4T1 (SEQ ID NO: 310), light chain: MRAL-k0 (SEQ ID NO: 16)), were subjected to a study in which an arbitrary amino acid residue structurally exposed to the surface was substituted with cysteine.

Amino acid residues within the MRA-IgG4 heavy chain variable region (MRAH, SEQ ID NO: 17) were substituted with cysteine to produce variants of the MRA-IgG4 heavy chain variable region shown in Table 22. These variants of the MRA-IgG4 heavy chain variable region were each linked with the MRA-IgG4 heavy chain constant region (G4T1, SEQ ID NO: 311) to produce MRA-IgG4 heavy chain variants, and expression vectors encoding the corresponding genes were produced by a method known to the person skilled in the art. In addition, amino acid residues within the MRA-IgG4 heavy chain constant region (G4T1, SEQ ID NO: 311) were substituted with cysteine to produce variants of the MRA-IgG4 heavy chain constant region shown in Table 23. These variants of the MRA-IgG4 heavy chain constant region were each linked with the MRA-IgG4 heavy chain variable region (MRAH, SEQ ID NO: 17) to produce MRA-IgG4 heavy chain variants, and expression vectors encoding the corresponding genes were produced by a method known to the person skilled in the art.

TABLE 22

| Variant of MRA-IgG4 heavy chain variable region | Position of cysteine substitution (Kabat numbering) | SEQ ID NO: |
|---|---|---|
| MRAH.Q5C | 5 | 322 |
| MRAH.E6C | 6 | 323 |
| MRAH.S7C | 7 | 324 |
| MRAH.G8C | 8 | 325 |
| MRAH.P9C | 9 | 326 |
| MRAH.G10C | 10 | 327 |
| MRAH.L11C | 11 | 328 |
| MRAH.V12C | 12 | 329 |
| MRAH.R13C | 13 | 330 |
| MRAH.P14C | 14 | 331 |
| MRAH.S15C | 15 | 332 |
| MRAH.Q16C | 16 | 333 |
| MRAH.T17C | 17 | 334 |
| MRAH.L18C | 18 | 335 |
| MRAH.S19C | 19 | 336 |
| MRAH.L20C | 20 | 337 |
| MRAH.T21C | 21 | 338 |
| MRAH.T23C | 23 | 339 |
| MRAH.S25C | 25 | 340 |
| MRAH.G26C | 26 | 341 |
| MRAH.S28C | 28 | 342 |
| MRAH.T30C | 30 | 343 |
| MRAH.S31C | 31 | 344 |
| MRAH.W35C | 35 | 345 |
| MRAH.S35aC | 35a | 346 |
| MRAH.Y50C | 50 | 347 |
| MRAH.I51C | 51 | 348 |
| MRAH.S52C | 52 | 349 |
| MRAH.S62C | 62 | 350 |
| MRAH.L63C | 63 | 351 |
| MRAH.K64C | 64 | 352 |
| MRAH.S65C | 65 | 353 |
| MRAH.R66C | 66 | 354 |
| MRAH.V67C | 67 | 355 |
| MRAH.T68C | 68 | 356 |
| MRAH.L70C | 70 | 357 |
| MRAH.D72C | 72 | 358 |
| MRAH.T73C | 73 | 359 |
| MRAH.S74C | 74 | 360 |
| MRAH.K75C | 75 | 361 |
| MRAH.N76C | 76 | 362 |
| MRAH.Q77C | 77 | 363 |
| MRAH.S79C | 79 | 364 |
| MRAH.L80C | 80 | 365 |
| MRAH.R81C | 81 | 366 |
| MRAH.L82C | 82 | 367 |
| MRAH.S82aC | 82a | 368 |
| MRAH.S82bC | 82b | 369 |
| MRAH.V82cC | 82c | 370 |
| MRAH.D101C | 101 | 371 |
| MRAH.Y102C | 102 | 372 |
| MRAH.S112C | 112 | 373 |
| MRAH.S113C | 113 | 374 |

TABLE 23

| Variant of MRA-IgG4 heavy chain constant region | Position of cysteine substitution (EU numbering) | SEQ ID NO: |
|---|---|---|
| G4T1.A118C | 118 | 611 |
| G4T1.S119C | 119 | 612 |
| G4T1.T120C | 120 | 613 |
| G4T1.K121C | 121 | 614 |
| G4T1.G122C | 122 | 615 |
| G4T1.P123C | 123 | 616 |
| G4T1.S124C | 124 | 617 |
| G4T1.V125C | 125 | 618 |
| G4T1.F126C | 126 | 619 |
| G4T1.P127C | 127 | 620 |
| G4T1.S132C | 132 | 621 |
| G4T1.R133C | 133 | 622 |
| G4T1.S134C | 134 | 623 |

TABLE 23-continued

| Variant of MRA-IgG4 heavy chain constant region | Position of cysteine substitution (EU numbering) | SEQ ID NO: |
|---|---|---|
| G4T1.T135C | 135 | 624 |
| G4T1.S136C | 136 | 625 |
| G4T1.E137C | 137 | 626 |
| G4T1.S138C | 138 | 627 |
| G4T1.T139C | 139 | 628 |
| G4T1.A140C | 140 | 629 |
| G4T1.A141C | 141 | 630 |
| G4T1.D148C | 148 | 631 |
| G4T1.Y149C | 149 | 632 |
| G4T1.F150C | 150 | 633 |
| G4T1.P151C | 151 | 634 |
| G4T1.E152C | 152 | 635 |
| G4T1.P153C | 153 | 636 |
| G4T1.V154C | 154 | 637 |
| G4T1.T155C | 155 | 638 |
| G4T1.V156C | 156 | 639 |
| G4T1.S157C | 157 | 640 |
| G4T1.W158C | 158 | 641 |
| G4T1.N159C | 159 | 642 |
| G4T1.S160C | 160 | 643 |
| G4T1.G161C | 161 | 644 |
| G4T1.A162C | 162 | 645 |
| G4T1.L163C | 163 | 646 |
| G4T1.T164C | 164 | 647 |
| G4T1.S165C | 165 | 648 |
| G4T1.G166C | 166 | 649 |
| G4T1.V167C | 167 | 650 |
| G4T1.V173C | 173 | 651 |
| G4T1.L174C | 174 | 652 |
| G4T1.Q175C | 175 | 653 |
| G4T1.S176C | 176 | 654 |
| G4T1.S177C | 177 | 655 |
| G4T1.G178C | 178 | 656 |
| G4T1.L179C | 179 | 657 |
| G4T1.Y180C | 180 | 658 |
| G4T1.V186C | 186 | 659 |
| G4T1.T187C | 187 | 660 |
| G4T1.V188C | 188 | 661 |
| G4T1.P189C | 189 | 662 |
| G4T1.S190C | 190 | 663 |
| G4T1.S191C | 191 | 664 |
| G4T1.S192C | 192 | 665 |
| G4T1.L193C | 193 | 666 |
| G4T1.G194C | 194 | 667 |
| G4T1.T195C | 195 | 668 |
| G4T1.Q196C | 196 | 669 |
| G4T1.T197C | 197 | 670 |
| G4T1.Y198C | 198 | 671 |
| G4T1.T199C | 199 | 672 |
| G4T1.N201C | 201 | 673 |
| G4T1.V202C | 202 | 674 |
| G4T1.D203C | 203 | 675 |
| G4T1.H204C | 204 | 676 |
| G4T1.K205C | 205 | 677 |
| G4T1.P206C | 206 | 678 |
| G4T1.S207C | 207 | 679 |
| G4T1.N208C | 208 | 680 |
| G4T1.T209C | 209 | 681 |
| G4T1.K210C | 210 | 682 |
| G4T1.V211C | 211 | 683 |
| G4T1.D212C | 212 | 684 |
| G4T1.K213C | 213 | 685 |
| G4T1.R214C | 214 | 686 |
| G4T1.V215C | 215 | 687 |
| G4T1.E216C | 216 | 688 |
| G4T1.S217C | 217 | 689 |
| G4T1.K218C | 218 | 690 |

The MRA-IgG4 heavy chain variants produced above were combined with the MRA-IgG4 light chain, or the MRA-IgG4 heavy chain was combined with the MRA-IgG4 light chain variants produced in Example 8-1. The resultant MRA-IgG4 heavy chain variants and MRA-IgG4 light chain variants shown in Tables 24 and 25 were expressed by transient expression using FreeStyle293 cells (Invitrogen) or Expi293 cells (Life technologies) by a method known to the person skilled in the art, and purified with Protein A by a method known to the person skilled in the art.

TABLE 24

| MRA-IgG4 heavy chain variant name | Heavy chain variable region SEQ ID NO: | Heavy chain constant region SEQ ID NO: | Light chain variable region SEQ ID NO: | Light chain constant region SEQ ID NO: |
|---|---|---|---|---|
| MRAH.Q5C-IgG4 | 322 | 311 | 19 | 20 |
| MRAH.E6C-IgG4 | 323 | 311 | 19 | 20 |
| MRAH.S7C-IgG4 | 324 | 311 | 19 | 20 |
| MRAH.G8C-IgG4 | 325 | 311 | 19 | 20 |
| MRAH.P9C-IgG4 | 326 | 311 | 19 | 20 |
| MRAH.G10C-IgG4 | 327 | 311 | 19 | 20 |
| MRAH.L11C-IgG4 | 328 | 311 | 19 | 20 |
| MRAH.V12C-IgG4 | 329 | 311 | 19 | 20 |
| MRAH.R13C-IgG4 | 330 | 311 | 19 | 20 |
| MRAH.P14C-IgG4 | 331 | 311 | 19 | 20 |
| MRAH.S15C-IgG4 | 332 | 311 | 19 | 20 |
| MRAH.Q16C-IgG4 | 333 | 311 | 19 | 20 |
| MRAH.T17C-IgG4 | 334 | 311 | 19 | 20 |
| MRAH.L18C-IgG4 | 335 | 311 | 19 | 20 |
| MRAH.S19C-IgG4 | 336 | 311 | 19 | 20 |
| MRAH.L20C-IgG4 | 337 | 311 | 19 | 20 |
| MRAH.T21C-IgG4 | 338 | 311 | 19 | 20 |
| MRAH.T23C-IgG4 | 339 | 311 | 19 | 20 |
| MRAH.S25C-IgG4 | 340 | 311 | 19 | 20 |
| MRAH.G26C-IgG4 | 341 | 311 | 19 | 20 |
| MRAH.S28C-IgG4 | 342 | 311 | 19 | 20 |
| MRAH.T30C-IgG4 | 343 | 311 | 19 | 20 |
| MRAH.S31C-IgG4 | 344 | 311 | 19 | 20 |
| MRAH.W35C-IgG4 | 345 | 311 | 19 | 20 |
| MRAH.S35aC-IgG4 | 346 | 311 | 19 | 20 |
| MRAH.Y50C-IgG4 | 347 | 311 | 19 | 20 |
| MRAH.I51C-IgG4 | 348 | 311 | 19 | 20 |
| MRAH.S52C-IgG4 | 349 | 311 | 19 | 20 |
| MRAH.S62C-IgG4 | 350 | 311 | 19 | 20 |
| MRAH.L63C-IgG4 | 351 | 311 | 19 | 20 |
| MRAH.K64C-IgG4 | 352 | 311 | 19 | 20 |
| MRAH.S65C-IgG4 | 353 | 311 | 19 | 20 |
| MRAH.R66C-IgG4 | 354 | 311 | 19 | 20 |
| MRAH.V67C-IgG4 | 355 | 311 | 19 | 20 |
| MRAH.T68C-IgG4 | 356 | 311 | 19 | 20 |
| MRAH.L70C-IgG4 | 357 | 311 | 19 | 20 |
| MRAH.D72C-IgG4 | 358 | 311 | 19 | 20 |
| MRAH.T73C-IgG4 | 359 | 311 | 19 | 20 |
| MRAH.S74C-IgG4 | 360 | 311 | 19 | 20 |
| MRAH.K75C-IgG4 | 361 | 311 | 19 | 20 |
| MRAH.N76C-IgG4 | 362 | 311 | 19 | 20 |
| MRAH.Q77C-IgG4 | 363 | 311 | 19 | 20 |
| MRAH.S79C-IgG4 | 364 | 311 | 19 | 20 |
| MRAH.L80C-IgG4 | 365 | 311 | 19 | 20 |
| MRAH.R81C-IgG4 | 366 | 311 | 19 | 20 |
| MRAH.L82C-IgG4 | 367 | 311 | 19 | 20 |
| MRAH.S82aC-IgG4 | 368 | 311 | 19 | 20 |
| MRAH.S82bC-IgG4 | 369 | 311 | 19 | 20 |
| MRAH.V82cC-IgG4 | 370 | 311 | 19 | 20 |
| MRAH.D101C-IgG4 | 371 | 311 | 19 | 20 |
| MRAH.Y102C-IgG4 | 372 | 311 | 19 | 20 |
| MRAH.S112C-IgG4 | 373 | 311 | 19 | 20 |
| MRAH.S113C-IgG4 | 374 | 311 | 19 | 20 |
| G4T1.A118C-IgG4 | 17 | 611 | 19 | 20 |
| G4T1.S119C-IgG4 | 17 | 612 | 19 | 20 |
| G4T1.T120C-IgG4 | 17 | 613 | 19 | 20 |
| G4T1.K121C-IgG4 | 17 | 614 | 19 | 20 |
| G4T1.G122C-IgG4 | 17 | 615 | 19 | 20 |
| G4T1.P123C-IgG4 | 17 | 616 | 19 | 20 |
| G4T1.S124C-IgG4 | 17 | 617 | 19 | 20 |
| G4T1.V125C-IgG4 | 17 | 618 | 19 | 20 |
| G4T1.F126C-IgG4 | 17 | 619 | 19 | 20 |
| G4T1.P127C-IgG4 | 17 | 620 | 19 | 20 |
| G4T1.S132C-IgG4 | 17 | 621 | 19 | 20 |
| G4T1.R133C-IgG4 | 17 | 622 | 19 | 20 |
| G4T1.S134C-IgG4 | 17 | 623 | 19 | 20 |
| G4T1.T135C-IgG4 | 17 | 624 | 19 | 20 |
| G4T1.S136C-IgG4 | 17 | 625 | 19 | 20 |

TABLE 24-continued

| MRA-IgG4 heavy chain variant name | Heavy chain variable region SEQ ID NO: | Heavy chain constant region SEQ ID NO: | Light chain variable region SEQ ID NO: | Light chain constant region SEQ ID NO: |
|---|---|---|---|---|
| G4T1.E137C-IgG4 | 17 | 626 | 19 | 20 |
| G4T1.S138C-IgG4 | 17 | 627 | 19 | 20 |
| G4T1.T139C-IgG4 | 17 | 628 | 19 | 20 |
| G4T1.A140C-IgG4 | 17 | 629 | 19 | 20 |
| G4T1.A141C-IgG4 | 17 | 630 | 19 | 20 |
| G4T1.D148C-IgG4 | 17 | 631 | 19 | 20 |
| G4T1.Y149C-IgG4 | 17 | 632 | 19 | 20 |
| G4T1.F150C-IgG4 | 17 | 633 | 19 | 20 |
| G4T1.P151C-IgG4 | 17 | 634 | 19 | 20 |
| G4T1.E152C-IgG4 | 17 | 635 | 19 | 20 |
| G4T1.P153C-IgG4 | 17 | 636 | 19 | 20 |
| G4T1.V154C-IgG4 | 17 | 637 | 19 | 20 |
| G4T1.T155C-IgG4 | 17 | 638 | 19 | 20 |
| G4T1.V156C-IgG4 | 17 | 639 | 19 | 20 |
| G4T1.S157C-IgG4 | 17 | 640 | 19 | 20 |
| G4T1.W158C-IgG4 | 17 | 641 | 19 | 20 |
| G4T1.N159C-IgG4 | 17 | 642 | 19 | 20 |
| G4T1.S160C-IgG4 | 17 | 643 | 19 | 20 |
| G4T1.G161C-IgG4 | 17 | 644 | 19 | 20 |
| G4T1.A162C-IgG4 | 17 | 645 | 19 | 20 |
| G4T1.L163C-IgG4 | 17 | 646 | 19 | 20 |
| G4T1.T164C-IgG4 | 17 | 647 | 19 | 20 |
| G4T1.S165C-IgG4 | 17 | 648 | 19 | 20 |
| G4T1.G166C-IgG4 | 17 | 649 | 19 | 20 |
| G4T1.V167C-IgG4 | 17 | 650 | 19 | 20 |
| G4T1.V173C-IgG4 | 17 | 651 | 19 | 20 |
| G4T1.L174C-IgG4 | 17 | 652 | 19 | 20 |
| G4T1.Q175C-IgG4 | 17 | 653 | 19 | 20 |
| G4T1.S176C-IgG4 | 17 | 654 | 19 | 20 |
| G4T1.S177C-IgG4 | 17 | 655 | 19 | 20 |
| G4T1.G178C-IgG4 | 17 | 656 | 19 | 20 |
| G4T1.L179C-IgG4 | 17 | 657 | 19 | 20 |
| G4T1.Y180C-IgG4 | 17 | 658 | 19 | 20 |
| G4T1.V186C-IgG4 | 17 | 659 | 19 | 20 |
| G4T1.T187C-IgG4 | 17 | 660 | 19 | 20 |
| G4T1.V188C-IgG4 | 17 | 661 | 19 | 20 |
| G4T1.P189C-IgG4 | 17 | 662 | 19 | 20 |
| G4T1.S190C-IgG4 | 17 | 663 | 19 | 20 |
| G4T1.S191C-IgG4 | 17 | 664 | 19 | 20 |
| G4T1.S192C-IgG4 | 17 | 665 | 19 | 20 |
| G4T1.L193C-IgG4 | 17 | 666 | 19 | 20 |
| G4T1.G194C-IgG4 | 17 | 667 | 19 | 20 |
| G4T1.T195C-IgG4 | 17 | 668 | 19 | 20 |
| G4T1.Q196C-IgG4 | 17 | 669 | 19 | 20 |
| G4T1.T197C-IgG4 | 17 | 670 | 19 | 20 |
| G4T1.Y198C-IgG4 | 17 | 671 | 19 | 20 |
| G4T1.T199C-IgG4 | 17 | 672 | 19 | 20 |
| G4T1.N201C-IgG4 | 17 | 673 | 19 | 20 |
| G4T1.V202C-IgG4 | 17 | 674 | 19 | 20 |
| G4T1.D203C-IgG4 | 17 | 675 | 19 | 20 |
| G4T1.H204C-IgG4 | 17 | 676 | 19 | 20 |
| G4T1.K205C-IgG4 | 17 | 677 | 19 | 20 |
| G4T1.P206C-IgG4 | 17 | 678 | 19 | 20 |
| G4T1.S207C-IgG4 | 17 | 679 | 19 | 20 |
| G4T1.N208C-IgG4 | 17 | 680 | 19 | 20 |
| G4T1.T209C-IgG4 | 17 | 681 | 19 | 20 |
| G4T1.K210C-IgG4 | 17 | 682 | 19 | 20 |
| G4T1.V211C-IgG4 | 17 | 683 | 19 | 20 |
| G4T1.D212C-IgG4 | 17 | 684 | 19 | 20 |
| G4T1.K213C-IgG4 | 17 | 685 | 19 | 20 |
| G4T1.R214C-IgG4 | 17 | 686 | 19 | 20 |
| G4T1.V215C-IgG4 | 17 | 687 | 19 | 20 |
| G4T1.E216C-IgG4 | 17 | 688 | 19 | 20 |
| G4T1.S217C-IgG4 | 17 | 689 | 19 | 20 |
| G4T1.K218C-IgG4 | 17 | 690 | 19 | 20 |

TABLE 25

| MRA-IgG4 light chain variant name | Heavy chain variable region SEQ ID NO: | Heavy chain constant region SEQ ID NO: | Light chain variable region SEQ ID NO: | Light chain constant region SEQ ID NO: |
|---|---|---|---|---|
| MRAL.T5C-IgG4 | 17 | 311 | 457 | 20 |
| MRAL.Q6C-IgG4 | 17 | 311 | 458 | 20 |
| MRAL.S7C-IgG4 | 17 | 311 | 459 | 20 |
| MRAL.P8C-IgG4 | 17 | 311 | 460 | 20 |
| MRAL.S9C-IgG4 | 17 | 311 | 461 | 20 |
| MRAL.S10C-IgG4 | 17 | 311 | 462 | 20 |
| MRAL.L11C-IgG4 | 17 | 311 | 463 | 20 |
| MRAL.S12C-IgG4 | 17 | 311 | 464 | 20 |
| MRAL.A13C-IgG4 | 17 | 311 | 465 | 20 |
| MRAL.S14C-IgG4 | 17 | 311 | 466 | 20 |
| MRAL.V15C-IgG4 | 17 | 311 | 467 | 20 |
| MRAL.G16C-IgG4 | 17 | 311 | 468 | 20 |
| MRAL.D17C-IgG4 | 17 | 311 | 469 | 20 |
| MRAL.R18C-IgG4 | 17 | 311 | 470 | 20 |
| MRAL.V19C-IgG4 | 17 | 311 | 471 | 20 |
| MRAL.T20C-IgG4 | 17 | 311 | 472 | 20 |
| MRAL.I21C-IgG4 | 17 | 311 | 473 | 20 |
| MRAL.T22C-IgG4 | 17 | 311 | 474 | 20 |
| MRAL.A25C-IgG4 | 17 | 311 | 475 | 20 |
| MRAL.S26C-IgG4 | 17 | 311 | 476 | 20 |
| MRAL.Q27C-IgG4 | 17 | 311 | 477 | 20 |
| MRAL.Y32C-IgG4 | 17 | 311 | 478 | 20 |
| MRAL.L33C-IgG4 | 17 | 311 | 479 | 20 |
| MRAL.N34C-IgG4 | 17 | 311 | 480 | 20 |
| MRAL.Y50C-IgG4 | 17 | 311 | 481 | 20 |
| MRAL.T51C-IgG4 | 17 | 311 | 482 | 20 |
| MRAL.H55C-IgG4 | 17 | 311 | 483 | 20 |
| MRAL.S56C-IgG4 | 17 | 311 | 484 | 20 |
| MRAL.G57C-IgG4 | 17 | 311 | 485 | 20 |
| MRAL.V58C-IgG4 | 17 | 311 | 486 | 20 |
| MRAL.P59C-IgG4 | 17 | 311 | 487 | 20 |
| MRAL.S60C-IgG4 | 17 | 311 | 488 | 20 |
| MRAL.R61C-IgG4 | 17 | 311 | 489 | 20 |
| MRAL.F62C-IgG4 | 17 | 311 | 490 | 20 |
| MRAL.S63C-IgG4 | 17 | 311 | 491 | 20 |
| MRAL.S65C-IgG4 | 17 | 311 | 492 | 20 |
| MRAL.S67C-IgG4 | 17 | 311 | 493 | 20 |
| MRAL.G68C-IgG4 | 17 | 311 | 494 | 20 |
| MRAL.T69C-IgG4 | 17 | 311 | 495 | 20 |
| MRAL.D70C-IgG4 | 17 | 311 | 496 | 20 |
| MRAL.T72C-IgG4 | 17 | 311 | 497 | 20 |
| MRAL.F73C-IgG4 | 17 | 311 | 498 | 20 |
| MRAL.T74C-IgG4 | 17 | 311 | 499 | 20 |
| MRAL.I75C-IgG4 | 17 | 311 | 500 | 20 |
| MRAL.S76C-IgG4 | 17 | 311 | 501 | 20 |
| MRAL.S77C-IgG4 | 17 | 311 | 502 | 20 |
| MRAL.L78C-IgG4 | 17 | 311 | 503 | 20 |
| MRAL.Q79C-IgG4 | 17 | 311 | 504 | 20 |
| MRAL.Y96C-IgG4 | 17 | 311 | 505 | 20 |
| MRAL.T97C-IgG4 | 17 | 311 | 506 | 20 |
| MRAL.F98C-IgG4 | 17 | 311 | 507 | 20 |
| MRAL.G99C-IgG4 | 17 | 311 | 508 | 20 |
| MRAL.Q100C-IgG4 | 17 | 311 | 509 | 20 |
| MRAL.G101C-IgG4 | 17 | 311 | 510 | 20 |
| MRAL.T102C-IgG4 | 17 | 311 | 511 | 20 |
| MRAL.K103C-IgG4 | 17 | 311 | 512 | 20 |
| MRAL.V104C-IgG4 | 17 | 311 | 513 | 20 |
| MRAL.E105C-IgG4 | 17 | 311 | 514 | 20 |
| MRAL.I106C-IgG4 | 17 | 311 | 515 | 20 |
| MRAL.K107C-IgG4 | 17 | 311 | 516 | 20 |
| k0.R108C-IgG4 | 17 | 311 | 19 | 517 |
| k0.T109C-IgG4 | 17 | 311 | 19 | 518 |
| k0.V110C-IgG4 | 17 | 311 | 19 | 519 |
| k0.A111C-IgG4 | 17 | 311 | 19 | 520 |
| k0.A112C-IgG4 | 17 | 311 | 19 | 521 |
| k0.P113C-IgG4 | 17 | 311 | 19 | 522 |
| k0.S114C-IgG4 | 17 | 311 | 19 | 523 |
| k0.V115C-IgG4 | 17 | 311 | 19 | 524 |
| k0.F116C-IgG4 | 17 | 311 | 19 | 525 |
| k0.P120C-IgG4 | 17 | 311 | 19 | 526 |
| k0.S121C-IgG4 | 17 | 311 | 19 | 527 |
| k0.D122C-IgG4 | 17 | 311 | 19 | 528 |
| k0.E123C-IgG4 | 17 | 311 | 19 | 529 |

TABLE 25-continued

| MRA-IgG4 light chain variant name | Heavy chain variable region SEQ ID NO: | Heavy chain constant region SEQ ID NO: | Light chain variable region SEQ ID NO: | Light chain constant region SEQ ID NO: |
|---|---|---|---|---|
| k0.Q124C-IgG4 | 17 | 311 | 19 | 530 |
| k0.L125C-IgG4 | 17 | 311 | 19 | 531 |
| k0.K126C-IgG4 | 17 | 311 | 19 | 532 |
| k0.S127C-IgG4 | 17 | 311 | 19 | 533 |
| k0.G128C-IgG4 | 17 | 311 | 19 | 534 |
| k0.T129C-IgG4 | 17 | 311 | 19 | 535 |
| k0.A130C-IgG4 | 17 | 311 | 19 | 536 |
| k0.S131C-IgG4 | 17 | 311 | 19 | 537 |
| k0.L136C-IgG4 | 17 | 311 | 19 | 538 |
| k0.N137C-IgG4 | 17 | 311 | 19 | 539 |
| k0.N138C-IgG4 | 17 | 311 | 19 | 540 |
| k0.F139C-IgG4 | 17 | 311 | 19 | 541 |
| k0.Y140C-IgG4 | 17 | 311 | 19 | 542 |
| k0.P141C-IgG4 | 17 | 311 | 19 | 543 |
| k0.R142C-IgG4 | 17 | 311 | 19 | 544 |
| k0.E143C-IgG4 | 17 | 311 | 19 | 545 |
| k0.A144C-IgG4 | 17 | 311 | 19 | 546 |
| k0.K145C-IgG4 | 17 | 311 | 19 | 547 |
| k0.V146C-IgG4 | 17 | 311 | 19 | 548 |
| k0.Q147C-IgG4 | 17 | 311 | 19 | 549 |
| k0.W148C-IgG4 | 17 | 311 | 19 | 550 |
| k0.K149C-IgG4 | 17 | 311 | 19 | 551 |
| k0.V150C-IgG4 | 17 | 311 | 19 | 552 |
| k0.D151C-IgG4 | 17 | 311 | 19 | 553 |
| k0.N152C-IgG4 | 17 | 311 | 19 | 554 |
| k0.A153C-IgG4 | 17 | 311 | 19 | 555 |
| k0.L154C-IgG4 | 17 | 311 | 19 | 556 |
| k0.Q155C-IgG4 | 17 | 311 | 19 | 557 |
| k0.S156C-IgG4 | 17 | 311 | 19 | 558 |
| k0.G157C-IgG4 | 17 | 311 | 19 | 559 |
| k0.N158C-IgG4 | 17 | 311 | 19 | 560 |
| k0.S159C-IgG4 | 17 | 311 | 19 | 561 |
| k0.Q160C-IgG4 | 17 | 311 | 19 | 562 |
| k0.E161C-IgG4 | 17 | 311 | 19 | 563 |
| k0.S162C-IgG4 | 17 | 311 | 19 | 564 |
| k0.V163C-IgG4 | 17 | 311 | 19 | 565 |
| k0.T164C-IgG4 | 17 | 311 | 19 | 566 |
| k0.E165C-IgG4 | 17 | 311 | 19 | 567 |
| k0.Q166C-IgG4 | 17 | 311 | 19 | 568 |
| k0.D167C-IgG4 | 17 | 311 | 19 | 569 |
| k0.S168C-IgG4 | 17 | 311 | 19 | 570 |
| k0.K169C-IgG4 | 17 | 311 | 19 | 571 |
| k0.D170C-IgG4 | 17 | 311 | 19 | 572 |
| k0.S171C-IgG4 | 17 | 311 | 19 | 573 |
| k0.T172C-IgG4 | 17 | 311 | 19 | 574 |
| k0.Y173C-IgG4 | 17 | 311 | 19 | 575 |
| k0.S174C-IgG4 | 17 | 311 | 19 | 576 |
| k0.L175C-IgG4 | 17 | 311 | 19 | 577 |
| k0.T180C-IgG4 | 17 | 311 | 19 | 578 |
| k0.L181C-IgG4 | 17 | 311 | 19 | 579 |
| k0.S182C-IgG4 | 17 | 311 | 19 | 580 |
| k0.K183C-IgG4 | 17 | 311 | 19 | 581 |
| k0.A184C-IgG4 | 17 | 311 | 19 | 582 |
| k0.D185C-IgG4 | 17 | 311 | 19 | 583 |
| k0.Y186C-IgG4 | 17 | 311 | 19 | 584 |
| k0.E187C-IgG4 | 17 | 311 | 19 | 585 |
| k0.K188C-IgG4 | 17 | 311 | 19 | 586 |
| k0.H189C-IgG4 | 17 | 311 | 19 | 587 |
| k0.K190C-IgG4 | 17 | 311 | 19 | 588 |
| k0.V191C-IgG4 | 17 | 311 | 19 | 589 |
| k0.Y192C-IgG4 | 17 | 311 | 19 | 590 |
| k0.A193C-IgG4 | 17 | 311 | 19 | 591 |
| k0.E195C-IgG4 | 17 | 311 | 19 | 592 |
| k0.V196C-IgG4 | 17 | 311 | 19 | 593 |
| k0.T197C-IgG4 | 17 | 311 | 19 | 594 |
| k0.H198C-IgG4 | 17 | 311 | 19 | 595 |
| k0.Q199C-IgG4 | 17 | 311 | 19 | 596 |
| k0.G200C-IgG4 | 17 | 311 | 19 | 597 |
| k0.L201C-IgG4 | 17 | 311 | 19 | 598 |
| k0.S202C-IgG4 | 17 | 311 | 19 | 599 |
| k0.S203C-IgG4 | 17 | 311 | 19 | 600 |
| k0.P204C-IgG4 | 17 | 311 | 19 | 601 |
| k0.V205C-IgG4 | 17 | 311 | 19 | 602 |
| k0.T206C-IgG4 | 17 | 311 | 19 | 603 |
| k0.K207C-IgG4 | 17 | 311 | 19 | 604 |
| k0.S208C-IgG4 | 17 | 311 | 19 | 605 |
| k0.F209C-IgG4 | 17 | 311 | 19 | 606 |
| k0.N210C-IgG4 | 17 | 311 | 19 | 607 |
| k0.R211C-IgG4 | 17 | 311 | 19 | 608 |
| k0.G212C-IgG4 | 17 | 311 | 19 | 609 |
| k0.E213C-IgG4 | 17 | 311 | 19 | 610 |

Example 9-2 Assessment of Electrophoretic Mobility in Polyacrylamide Gel of Antibodies Having Cysteine Substitution at Various Positions of IgG4

Similarly to Example 8-2, non-reducing SDS-PAGE was carried out with the MRA-IgG4 variants produced in Example 9-1, the gel image was captured, and bands were quantified.

From the obtained gel image, the variants were classified into 7 groups according to the band pattern of each of the MRA-IgG4 variants: Single (one band at a molecular weight region similar to that of MRA-IgG4), Double (two bands at a molecular weight region similar to that of MRA-IgG4), Triple (three bands at a molecular weight region similar to that of MRA-IgG4), Several (four or more bands at a molecular weight region similar to that of MRA-IgG4), LMW (band(s) at a molecular weight region lower than that of MRA-IgG4), HMW (band(s) at a molecular weight region higher than that of MRA-IgG4), and Faint (band(s) blurry and difficult to determine). Regarding the MRA-IgG4 variants classified as "Double", one of the two bands showed the same electrophoretic mobility as MRA-IgG4 while the other band showed slightly faster or slower mobility. Thus, for the MRA-IgG4 variants classified as "Double", the percentage of the bands showing different mobility to MRA-IgG4 (percentage of new band (%)) was also calculated. Grouping of the band patterns for MRA-IgG4 heavy chain variants and MRA-IgG4 light chain variants, and the calculation results of the band percentage are respectively shown in Tables 26 and 27. From Tables 26 and 27, variants classified into the Double and Triple groups are shown in Table 28. In these variants, it is highly likely that cysteine substitution caused structural changes such as crosslinkage of Fabs, which resulted in the change in electrophoretic mobility. It is noted that while Table 27 indicates "no data" for MRAL.K107C-IgG4, position 107 (Kabat numbering), which is the position of cysteine substitution in this variant, is a position where the residue structurally exposed to the surface is present in the hinge region. Thus, in this variant also, it is highly likely that cysteine substitution causes structural changes such as crosslinkage of Fabs, and results in the change in electrophoretic mobility.

TABLE 26

| MRA-IgG4 heavy chain variant name | Group | Percentage of new band (%) |
|---|---|---|
| MRAH.Q5C-IgG4 | Single | — |
| MRAH.E6C-IgG4 | Double | 5.8 |

TABLE 26-continued

| MRA-IgG4 heavy chain variant name | Group | Percentage of new band (%) |
|---|---|---|
| MRAH.S7C-IgG4 | Single | — |
| MRAH.G8C-IgG4 | Single | — |
| MRAH.P9C-IgG4 | Single | — |
| MRAH.G10C-IgG4 | Single | — |
| MRAH.L11C-IgG4 | Single | — |
| MRAH.V12C-IgG4 | Faint | — |
| MRAH.R13C-IgG4 | Single | — |
| MRAH.P14C-IgG4 | Single | — |
| MRAH.S15C-IgG4 | Single | — |
| MRAH.Q16C-IgG4 | Single | — |
| MRAH.T17C-IgG4 | Single | — |
| MRAH.L18C-IgG4 | LMW | — |
| MRAH.S19C-IgG4 | Single | — |
| MRAH.L20C-IgG4 | LMW | — |
| MRAH.T21C-IgG4 | Single | — |
| MRAH.T23C-IgG4 | Single | — |
| MRAH.S25C-IgG4 | Double | 62.1 |
| MRAH.G26C-IgG4 | Double | 9.4 |
| MRAH.S28C-IgG4 | Single | — |
| MRAH.T30C-IgG4 | Single | — |
| MRAH.S31C-IgG4 | Single | — |
| MRAH.W35C-IgG4 | LMW | — |
| MRAH.S35aC-IgG4 | LMW | — |
| MRAH.Y50C-IgG4 | Single | — |
| MRAH.I51C-IgG4 | LMW | — |
| MRAH.S52C-IgG4 | Single | — |
| MRAH.S62C-IgG4 | Single | — |
| MRAH.L63C-IgG4 | Single | — |
| MRAH.K64C-IgG4 | Single | — |
| MRAH.S65C-IgG4 | Single | — |
| MRAH.R66C-IgG4 | Single | — |
| MRAH.V67C-IgG4 | LMW | — |
| MRAH.T68C-IgG4 | Single | — |
| MRAH.L70C-IgG4 | Single | — |
| MRAH.D72C-IgG4 | Single | — |
| MRAH.T73C-IgG4 | Single | — |
| MRAH.S74C-IgG4 | Double | 5.3 |
| MRAH.K75C-IgG4 | Single | — |
| MRAH.N76C-IgG4 | Single | — |
| MRAH.Q77C-IgG4 | Single | — |
| MRAH.S79C-IgG4 | Single | — |
| MRAH.L80C-IgG4 | LMW | — |
| MRAH.R81C-IgG4 | Single | — |
| MRAH.L82C-IgG4 | LMW | — |
| MRAH.S82aC-IgG4 | Single | — |
| MRAH.S82bC-IgG4 | Single | — |
| MRAH.V82cC-IgG4 | LMW | — |
| MRAH.D101C-IgG4 | Single | — |
| MRAH.Y102C-IgG4 | Single | — |
| MRAH.S112C-IgG4 | Single | — |
| MRAH.S113C-IgG4 | Single | — |
| G4T1.A118C-IgG4 | Single | — |
| G4T1.S119C-IgG4 | Double | 11 |
| G4T1.T120C-IgG4 | Single | — |
| G4T1.K121C-IgG4 | Single | — |
| G4T1.G122C-IgG4 | Single | — |
| G4T1.P123C-IgG4 | LMW | — |
| G4T1.S124C-IgG4 | Single | — |
| G4T1.V125C-IgG4 | LMW | — |
| G4T1.F126C-IgG4 | LMW | — |
| G4T1.P127C-IgG4 | LMW | — |
| G4T1.S132C-IgG4 | Triple | — |
| G4T1.R133C-IgG4 | Double | 82.9 |
| G4T1.S134C-IgG4 | Double | 80.4 |
| G4T1.T135C-IgG4 | Double | 88.6 |
| G4T1.S136C-IgG4 | Double | 82.4 |
| G4T1.E137C-IgG4 | Double | 44.7 |
| G4T1.S138C-IgG4 | Double | 52.6 |
| G4T1.T139C-IgG4 | Single | — |
| G4T1.A140C-IgG4 | Triple | — |
| G4T1.A141C-IgG4 | Single | — |
| G4T1.D148C-IgG4 | Single | — |
| G4T1.Y149C-IgG4 | Faint | — |
| G4T1.F150C-IgG4 | Single | — |
| G4T1.P151C-IgG4 | LMW | — |
| G4T1.E152C-IgG4 | Single | — |
| G4T1.P153C-IgG4 | Single | — |

TABLE 26-continued

| MRA-IgG4 heavy chain variant name | Group | Percentage of new band (%) |
|---|---|---|
| G4T1.V154C-IgG4 | LMW | — |
| G4T1.T155C-IgG4 | Single | — |
| G4T1.V156C-IgG4 | LMW | — |
| G4T1.S157C-IgG4 | Single | — |
| G4T1.W158C-IgG4 | LMW | — |
| G4T1.N159C-IgG4 | Double | 19.9 |
| G4T1.S160C-IgG4 | Double | 29.5 |
| G4T1.G161C-IgG4 | Double | 21.4 |
| G4T1.A162C-IgG4 | Double | 35.6 |
| G4T1.L163C-IgG4 | Double | 21.1 |
| G4T1.T164C-IgG4 | Double | 12.8 |
| G4T1.S165C-IgG4 | Double | 17 |
| G4T1.G166C-IgG4 | Double | 13 |
| G4T1.V167C-IgG4 | Double | 20.4 |
| G4T1.V173C-IgG4 | Double | 15.6 |
| G4T1.L174C-IgG4 | Double | 18.6 |
| G4T1.Q175C-IgG4 | Single | — |
| G4T1.S176C-IgG4 | Double | 20.3 |
| G4T1.S177C-IgG4 | Single | — |
| G4T1.G178C-IgG4 | Double | 22.5 |
| G4T1.L179C-IgG4 | Double | 26.1 |
| G4T1.Y180C-IgG4 | LMW | — |
| G4T1.V186C-IgG4 | LMW | — |
| G4T1.T187C-IgG4 | Double | 23.3 |
| G4T1.V188C-IgG4 | Double | 25.5 |
| G4T1.P189C-IgG4 | Double | 30.4 |
| G4T1.S190C-IgG4 | Double | 54.7 |
| G4T1.S191C-IgG4 | Double | 78.3 |
| G4T1.S192C-IgG4 | Double | 46.9 |
| G4T1.L193C-IgG4 | Double | 89.5 |
| G4T1.G194C-IgG4 | Double | 89.2 |
| G4T1.T195C-IgG4 | Double | 90.3 |
| G4T1.Q196C-IgG4 | Double | 63.4 |
| G4T1.T197C-IgG4 | Double | 79.8 |
| G4T1.Y198C-IgG4 | LMW | — |
| G4T1.T199C-IgG4 | LMW | — |
| G4T1.N201C-IgG4 | LMW | — |
| G4T1.V202C-IgG4 | LMW | — |
| G4T1.D203C-IgG4 | LMW | — |
| G4T1.H204C-IgG4 | LMW | — |
| G4T1.K205C-IgG4 | LMW | — |
| G4T1.P206C-IgG4 | LMW | — |
| G4T1.S207C-IgG4 | LMW | — |
| G4T1.N208C-IgG4 | LMW | — |
| G4T1.T209C-IgG4 | LMW | — |
| G4T1.K210C-IgG4 | Single | — |
| G4T1.V211C-IgG4 | Single | — |
| G4T1.D212C-IgG4 | Single | — |
| G4T1.K213C-IgG4 | Triple | — |
| G4T1.R214C-IgG4 | Single | — |
| G4T1.V215C-IgG4 | Double | 57.3 |
| G4T1.E216C-IgG4 | Single | — |
| G4T1.S217C-IgG4 | Single | — |
| G4T1.K218C-IgG4 | Single | — |

TABLE 27

| MRA-IgG4 light chain variant name | Group | Percentage of new band (%) |
|---|---|---|
| MRAL.T5C-IgG4 | HMW | — |
| MRAL.Q6C-IgG4 | Faint | — |
| MRAL.S7C-IgG4 | Single | — |
| MRAL.P8C-IgG4 | no data | — |
| MRAL.S9C-IgG4 | Single | — |
| MRAL.S10C-IgG4 | Single | — |
| MRAL.L11C-IgG4 | Single | — |
| MRAL.S12C-IgG4 | Single | — |
| MRAL.A13C-IgG4 | Single | — |
| MRAL.S14C-IgG4 | Single | — |
| MRAL.V15C-IgG4 | Single | — |
| MRAL.G16C-IgG4 | Single | — |
| MRAL.D17C-IgG4 | Single | — |
| MRAL.R18C-IgG4 | Single | — |

TABLE 27-continued

| MRA-IgG4 light chain variant name | Group | Percentage of new band (%) |
|---|---|---|
| MRAL.V19C-IgG4 | Double | 29.2 |
| MRAL.T20C-IgG4 | Single | — |
| MRAL.I21C-IgG4 | Faint | — |
| MRAL.T22C-IgG4 | Single | — |
| MRAL.A25C-IgG4 | Faint | — |
| MRAL.S26C-IgG4 | Single | — |
| MRAL.Q27C-IgG4 | Single | — |
| MRAL.Y32C-IgG4 | Single | — |
| MRAL.L33C-IgG4 | Faint | — |
| MRAL.N34C-IgG4 | Faint | — |
| MRAL.Y50C-IgG4 | Single | — |
| MRAL.T51C-IgG4 | Single | — |
| MRAL.H55C-IgG4 | Single | — |
| MRAL.S56C-IgG4 | Double | 12.2 |
| MRAL.G57C-IgG4 | Double | 13.5 |
| MRAL.V58C-IgG4 | Double | 12.3 |
| MRAL.P59C-IgG4 | Double | 3.4 |
| MRAL.S60C-IgG4 | Double | 17.9 |
| MRAL.R61C-IgG4 | Single | — |
| MRAL.F62C-IgG4 | Double | 39.1 |
| MRAL.S63C-IgG4 | Single | — |
| MRAL.S65C-IgG4 | Single | — |
| MRAL.S67C-IgG4 | Single | — |
| MRAL.G68C-IgG4 | Single | — |
| MRAL.T69C-IgG4 | Single | — |
| MRAL.D70C-IgG4 | Single | — |
| MRAL.T72C-IgG4 | Single | — |
| MRAL.F73C-IgG4 | Double | 36.9 |
| MRAL.T74C-IgG4 | Single | — |
| MRAL.I75C-IgG4 | no data | — |
| MRAL.S76C-IgG4 | Single | — |
| MRAL.S77C-IgG4 | Double | 51.2 |
| MRAL.L78C-IgG4 | Faint | — |
| MRAL.Q79C-IgG4 | Single | — |
| MRAL.Y96C-IgG4 | Faint | — |
| MRAL.T97C-IgG4 | Single | — |
| MRAL.F98C-IgG4 | Faint | — |
| MRAL.G99C-IgG4 | Double | 26.7 |
| MRAL.Q100C-IgG4 | Single | — |
| MRAL.G101C-IgG4 | Single | — |
| MRAL.T102C-IgG4 | Faint | — |
| MRAL.K103C-IgG4 | Single | — |
| MRAL.V104C-IgG4 | Faint | — |
| MRAL.E105C-IgG4 | Single | — |
| MRAL.I106C-IgG4 | Faint | — |
| MRAL.K107C-IgG4 | no data | — |
| k0.R108C-IgG4 | Single | — |
| k0.T109C-IgG4 | Double | 14.5 |
| k0.V110C-IgG4 | Double | 13.2 |
| k0.A111C-IgG4 | Single | — |
| k0.A112C-IgG4 | Double | 12 |
| k0.P113C-IgG4 | Single | — |
| k0.S114C-IgG4 | Single | — |
| k0.V115C-IgG4 | Faint | — |
| k0.F116C-IgG4 | Triple | — |
| k0.P120C-IgG4 | Faint | — |
| k0.S121C-IgG4 | Single | — |
| k0.D122C-IgG4 | LMW | — |
| k0.E123C-IgG4 | Single | — |
| k0.Q124C-IgG4 | Faint | — |
| k0.L125C-IgG4 | Single | — |
| k0.K126C-IgG4 | Double | 86.3 |
| k0.S127C-IgG4 | Single | — |
| k0.G128C-IgG4 | Single | — |
| k0.T129C-IgG4 | Single | — |
| k0.A130C-IgG4 | Faint | — |
| k0.S131C-IgG4 | LMW | — |
| k0.L136C-IgG4 | LMW | — |
| k0.N137C-IgG4 | Triple | — |
| k0.N138C-IgG4 | Single | — |
| k0.F139C-IgG4 | LMW | — |
| k0.Y140C-IgG4 | LMW | — |
| k0.P141C-IgG4 | Single | — |
| k0.R142C-IgG4 | Single | — |
| k0.E143C-IgG4 | Single | — |
| k0.A144C-IgG4 | LMW | — |
| k0.K145C-IgG4 | Single | — |
| k0.V146C-IgG4 | LMW | — |
| k0.Q147C-IgG4 | Single | — |
| k0.W148C-IgG4 | LMW | — |
| k0.K149C-IgG4 | Single | — |
| k0.V150C-IgG4 | LMW | — |
| k0.D151C-IgG4 | Double | 21.9 |
| k0.N152C-IgG4 | Double | 68.7 |
| k0.A153C-IgG4 | Single | — |
| k0.L154C-IgG4 | Single | — |
| k0.Q155C-IgG4 | Single | — |
| k0.S156C-IgG4 | HMW | — |
| k0.G157C-IgG4 | Single | — |
| k0.N158C-IgG4 | Single | — |
| k0.S159C-IgG4 | Single | — |
| k0.Q160C-IgG4 | Single | — |
| k0.E161C-IgG4 | Single | — |
| k0.S162C-IgG4 | Single | — |
| k0.V163C-IgG4 | Single | — |
| k0.T164C-IgG4 | Single | — |
| k0.E165C-IgG4 | Single | — |
| k0.Q166C-IgG4 | Single | — |
| k0.D167C-IgG4 | Single | — |
| k0.S168C-IgG4 | Single | — |
| k0.K169C-IgG4 | Single | — |
| k0.D170C-IgG4 | Single | — |
| k0.S171C-IgG4 | Single | — |
| k0.T172C-IgG4 | Faint | — |
| k0.Y173C-IgG4 | Faint | — |
| k0.S174C-IgG4 | Faint | — |
| k0.L175C-IgG4 | Faint | — |
| k0.T180C-IgG4 | Single | — |
| k0.L181C-IgG4 | Faint | — |
| k0.S182C-IgG4 | Single | — |
| k0.K183C-IgG4 | Single | — |
| k0.A184C-IgG4 | Double | 11.8 |
| k0.D185C-IgG4 | Single | — |
| k0.Y186C-IgG4 | Double | 31.7 |
| k0.E187C-IgG4 | LMW | — |
| k0.K188C-IgG4 | Single | — |
| k0.H189C-IgG4 | Faint | — |
| k0.K190C-IgG4 | LMW | — |
| k0.V191C-IgG4 | LMW | — |
| k0.Y192C-IgG4 | Faint | — |
| k0.A193C-IgG4 | Single | — |
| k0.E195C-IgG4 | Single | — |
| k0.V196C-IgG4 | Faint | — |
| k0.T197C-IgG4 | Single | — |
| k0.H198C-IgG4 | Faint | — |
| k0.Q199C-IgG4 | Single | — |
| k0.G200C-IgG4 | Double | 21.7 |
| k0.L201C-IgG4 | Double | 3.7 |
| k0.S202C-IgG4 | Double | 61.5 |
| k0.S203C-IgG4 | Double | 39 |
| k0.P204C-IgG4 | Single | — |
| k0.V205C-IgG4 | Single | — |
| k0.T206C-IgG4 | Single | — |
| k0.K207C-IgG4 | Single | — |
| k0.S208C-IgG4 | Single | — |
| k0.F209C-IgG4 | Double | 82.2 |
| k0.N210C-IgG4 | LMW | — |
| k0.R211C-IgG4 | Double | 12.1 |
| k0.G212C-IgG4 | Double | 25.6 |
| k0.E213C-IgG4 | Double | 90.9 |

TABLE 28

| MRA-IgG4 variant name | Group | Percentage of new band (%) |
|---|---|---|
| MRAH.E6C-IgG4 | Double | 5.8 |
| MRAH.S25C-IgG4 | Double | 62.1 |
| MRAH.G26C-IgG4 | Double | 9.4 |
| MRAH.S74C-IgG4 | Double | 5.3 |
| G4T1.S119C-IgG4 | Double | 11 |

TABLE 28-continued

| MRA-IgG4 variant name | Group | Percentage of new band (%) |
|---|---|---|
| G4T1.S132C-IgG4 | Triple | — |
| G4T1.R133C-IgG4 | Double | 82.9 |
| G4T1.S134C-IgG4 | Double | 80.4 |
| G4T1.T135C-IgG4 | Double | 88.6 |
| G4T1.S136C-IgG4 | Double | 82.4 |
| G4T1.E137C-IgG4 | Double | 44.7 |
| G4T1.S138C-IgG4 | Double | 52.6 |
| G4T1.A140C-IgG4 | Triple | — |
| G4T1.N159C-IgG4 | Double | 19.9 |
| G4T1.S160C-IgG4 | Double | 29.5 |
| G4T1.G161C-IgG4 | Double | 21.4 |
| G4T1.A162C-IgG4 | Double | 35.6 |
| G4T1.L163C-IgG4 | Double | 21.1 |
| G4T1.T164C-IgG4 | Double | 12.8 |
| G4T1.S165C-IgG4 | Double | 17 |
| G4T1.G166C-IgG4 | Double | 13 |
| G4T1.V167C-IgG4 | Double | 20.4 |
| G4T1.V173C-IgG4 | Double | 15.6 |
| G4T1.L174C-IgG4 | Double | 18.6 |
| G4T1.S176C-IgG4 | Double | 20.3 |
| G4T1.G178C-IgG4 | Double | 22.5 |
| G4T1.L179C-IgG4 | Double | 26.1 |
| G4T1.T187C-IgG4 | Double | 23.3 |
| G4T1.V188C-IgG4 | Double | 25.5 |
| G4T1.P189C-IgG4 | Double | 30.4 |
| G4T1.S190C-IgG4 | Double | 54.7 |
| G4T1.S191C-IgG4 | Double | 78.3 |
| G4T1.S192C-IgG4 | Double | 46.9 |
| G4T1.L193C-IgG4 | Double | 89.5 |
| G4T1.G194C-IgG4 | Double | 89.2 |
| G4T1.T195C-IgG4 | Double | 90.3 |
| G4T1.Q196C-IgG4 | Double | 63.4 |
| G4T1.T197C-IgG4 | Double | 79.8 |
| G4T1.K213C-IgG4 | Triple | — |
| G4T1.V215C-IgG4 | Double | 57.3 |
| MRAL.V19C-IgG4 | Double | 29.2 |
| MRAL.S56C-IgG4 | Double | 12.2 |
| MRAL.G57C-IgG4 | Double | 13.5 |
| MRAL.V58C-IgG4 | Double | 12.3 |
| MRAL.P59C-IgG4 | Double | 3.4 |
| MRAL.S60C-IgG4 | Double | 17.9 |
| MRAL.F62C-IgG4 | Double | 39.1 |
| MRAL.F73C-IgG4 | Double | 36.9 |
| MRAL.S77C-IgG4 | Double | 51.2 |
| MRAL.G99C-IgG4 | Double | 26.7 |
| k0.T109C-IgG4 | Double | 14.5 |
| k0.V110C-IgG4 | Double | 13.2 |
| k0.A112C-IgG4 | Double | 12 |
| k0.F116C-IgG4 | Triple | — |
| k0.K126C-IgG4 | Double | 86.3 |
| k0.N137C-IgG4 | Triple | — |
| k0.D151C-IgG4 | Double | 21.9 |
| k0.N152C-IgG4 | Double | 68.7 |
| k0.A184C-IgG4 | Double | 11.8 |
| k0.Y186C-IgG4 | Double | 31.7 |
| k0.G200C-IgG4 | Double | 21.7 |
| k0.L201C-IgG4 | Double | 3.7 |
| k0.S202C-IgG4 | Double | 61.5 |
| k0.S203C-IgG4 | Double | 39 |
| k0.F209C-IgG4 | Double | 82.2 |
| k0.R211C-IgG4 | Double | 12.1 |
| k0.G212C-IgG4 | Double | 25.6 |
| k0.E213C-IgG4 | Double | 90.9 |

Example 10 Assessment of Antibodies Having Cysteine Substitution at Various Positions of IgG2

Example 10$^{-1}$ Production of Antibodies Having Cysteine Substitution at Various Positions of IgG2

The heavy chain and light chain of an anti-human IL6R neutralizing antibody, MRA-IgG2 (heavy chain: MRAH-G2d (SEQ ID NO: 312), light chain: MRAL-k0 (SEQ ID NO: 16)), were subjected to a study in which an arbitrary amino acid residue structurally exposed to the surface was substituted with cysteine.

Amino acid residues within the MRA-IgG2 heavy chain variable region (MRAH, SEQ ID NO: 17) were substituted with cysteine to produce variants of the MRA-IgG2 heavy chain variable region shown in Table 29. These variants of the MRA-IgG2 heavy chain variable region were each linked with the MRA-IgG2 heavy chain constant region (G2d, SEQ ID NO: 313) to produce MRA-IgG2 heavy chain variants, and expression vectors encoding the corresponding genes were produced by a method known to the person skilled in the art. In addition, amino acid residues within the MRA-IgG2 heavy chain constant region (G2d, SEQ ID NO: 313) were substituted with cysteine to produce variants of the MRA-IgG2 heavy chain constant region shown in Table 30. These variants of the MRA-IgG2 heavy chain constant region were each linked with the MRA-IgG2 heavy chain variable region (MRAH, SEQ ID NO: 17) to produce MRA-IgG2 heavy chain variants, and expression vectors encoding the corresponding genes were produced by a method known to the person skilled in the art.

TABLE 29

| Variant of MRA-IgG2 heavy chain variable region | Position of cysteine substitution (Kabat numbering) | SEQ ID NO: |
|---|---|---|
| MRAH.Q5C | 5 | 322 |
| MRAH.E6C | 6 | 323 |
| MRAH.S7C | 7 | 324 |
| MRAH.G8C | 8 | 325 |
| MRAH.P9C | 9 | 326 |
| MRAH.G10C | 10 | 327 |
| MRAH.L11C | 11 | 328 |
| MRAH.V12C | 12 | 329 |
| MRAH.R13C | 13 | 330 |
| MRAH.P14C | 14 | 331 |
| MRAH.S15C | 15 | 332 |
| MRAH.Q16C | 16 | 333 |
| MRAH.T17C | 17 | 334 |
| MRAH.L18C | 18 | 335 |
| MRAH.S19C | 19 | 336 |
| MRAH.L20C | 20 | 337 |
| MRAH.T21C | 21 | 338 |
| MRAH.T23C | 23 | 339 |
| MRAH.S25C | 25 | 340 |
| MRAH.G26C | 26 | 341 |
| MRAH.S28C | 28 | 342 |
| MRAH.T30C | 30 | 343 |
| MRAH.S31C | 31 | 344 |
| MRAH.W35C | 35 | 345 |
| MRAH.S35aC | 35a | 346 |
| MRAH.Y50C | 50 | 347 |
| MRAH.I51C | 51 | 348 |
| MRAH.S52C | 52 | 349 |
| MRAH.S62C | 62 | 350 |
| MRAH.L63C | 63 | 351 |
| MRAH.K64C | 64 | 352 |
| MRAH.S65C | 65 | 353 |
| MRAH.R66C | 66 | 354 |
| MRAH.V67C | 67 | 355 |
| MRAH.T68C | 68 | 356 |
| MRAH.L70C | 70 | 357 |
| MRAH.D72C | 72 | 358 |
| MRAH.T73C | 73 | 359 |
| MRAH.S74C | 74 | 360 |
| MRAH.K75C | 75 | 361 |
| MRAH.N76C | 76 | 362 |
| MRAH.Q77C | 77 | 363 |
| MRAH.S79C | 79 | 364 |
| MRAH.L80C | 80 | 365 |
| MRAH.R81C | 81 | 366 |
| MRAH.L82C | 82 | 367 |
| MRAH.S82aC | 82a | 368 |

TABLE 29-continued

| Variant of MRA-IgG2 heavy chain variable region | Position of cysteine substitution (Kabat numbering) | SEQ ID NO: |
|---|---|---|
| MRAH.S82bC | 82b | 369 |
| MRAH.V82cC | 82c | 370 |
| MRAH.D101C | 101 | 371 |
| MRAH.Y102C | 102 | 372 |
| MRAH.S112C | 112 | 373 |
| MRAH.S113C | 113 | 374 |

TABLE 30

| Variant of MRA-IgG2 heavy chain constant region | Position of cysteine substitution (EU numbering) | SEQ ID NO: |
|---|---|---|
| G2d.A118C | 118 | 691 |
| G2d.S119C | 119 | 692 |
| G2d.T120C | 120 | 693 |
| G2d.K121C | 121 | 694 |
| G2d.G122C | 122 | 695 |
| G2d.P123C | 123 | 696 |
| G2d.S124C | 124 | 697 |
| G2d.V125C | 125 | 698 |
| G2d.F126C | 126 | 699 |
| G2d.P127C | 127 | 700 |
| G2d.S132C | 132 | 701 |
| G2d.R133C | 133 | 702 |
| G2d.S134C | 134 | 703 |
| G2d.T135C | 135 | 704 |
| G2d.S136C | 136 | 705 |
| G2d.E137C | 137 | 706 |
| G2d.S138C | 138 | 707 |
| G2d.T139C | 139 | 708 |
| G2d.A140C | 140 | 709 |
| G2d.A141C | 141 | 710 |
| G2d.D148C | 148 | 711 |
| G2d.Y149C | 149 | 712 |
| G2d.F150C | 150 | 713 |
| G2d.P151C | 151 | 714 |
| G2d.E152C | 152 | 715 |
| G2d.P153C | 153 | 716 |
| G2d.V154C | 154 | 717 |
| G2d.T155C | 155 | 718 |
| G2d.V156C | 156 | 719 |
| G2d.S157C | 157 | 720 |
| G2d.W158C | 158 | 721 |
| G2d.N159C | 159 | 722 |
| G2d.S160C | 160 | 723 |
| G2d.G161C | 161 | 724 |
| G2d.A162C | 162 | 725 |
| G2d.L163C | 163 | 726 |
| G2d.T164C | 164 | 727 |
| G2d.S165C | 165 | 728 |
| G2d.G166C | 166 | 729 |
| G2d.V167C | 167 | 730 |
| G2d.V173C | 173 | 731 |
| G2d.L174C | 174 | 732 |
| G2d.Q175C | 175 | 733 |
| G2d.S176C | 176 | 734 |
| G2d.S177C | 177 | 735 |
| G2d.G178C | 178 | 736 |
| G2d.L179C | 179 | 737 |
| G2d.Y180C | 180 | 738 |
| G2d.V186C | 186 | 739 |
| G2d.T187C | 187 | 740 |
| G2d.V188C | 188 | 741 |
| G2d.P189C | 189 | 742 |
| G2d.S190C | 190 | 743 |
| G2d.S191C | 191 | 744 |
| G2d.N192C | 192 | 745 |
| G2d.F193C | 193 | 746 |
| G2d.G194C | 194 | 747 |
| G2d.T195C | 195 | 748 |
| G2d.Q196C | 196 | 749 |
| G2d.T197C | 197 | 750 |
| G2d.Y198C | 198 | 751 |
| G2d.T199C | 199 | 752 |
| G2d.N201C | 201 | 753 |
| G2d.V202C | 202 | 754 |
| G2d.D203C | 203 | 755 |
| G2d.H204C | 204 | 756 |
| G2d.K205C | 205 | 757 |
| G2d.P206C | 206 | 758 |
| G2d.S207C | 207 | 759 |
| G2d.N208C | 208 | 760 |
| G2d.T209C | 209 | 761 |
| G2d.K210C | 210 | 762 |
| G2d.V211C | 211 | 763 |
| G2d.D212C | 212 | 764 |
| G2d.K213C | 213 | 765 |
| G2d.T214C | 214 | 766 |
| G2d.V215C | 215 | 767 |
| G2d.E216C | 216 | 768 |
| G2d.R217C | 217 | 769 |
| G2d.K218C | 218 | 770 |

The MRA-IgG2 heavy chain variants produced above were combined with the MRA-IgG2 light chain, orthe MRA-IgG2 heavy chain was combined with the MRA-IgG2 light chain variants produced in Example 8-1. The resuant MRA-IgG2 heavy chain variants and MRA-IgG2 light chain variants shown in Tables 31 and 32 were expressed by transient expression using FreeStyle293 cells (Invitrogen) or Expi293 cells (Life technologies) by a method known to the person skilled in the art, and purified with Protein A by a method known to the person skilled in the art.

TABLE 31

| MRA-IgG2 heavy chain variant name | Heavy chain variable region SEQ ID NO: | Heavy chain constant region SEQ ID NO: | Light chain variable region SEQ ID NO: | Light chain constant region SEQ ID NO: |
|---|---|---|---|---|
| MRAH.Q5C-IgG2 | 322 | 313 | 19 | 20 |
| MRAH.E6C-IgG2 | 323 | 313 | 19 | 20 |
| MRAH.S7C-IgG2 | 324 | 313 | 19 | 20 |
| MRAH.G8C-IgG2 | 325 | 313 | 19 | 20 |
| MRAH.P9C-IgG2 | 326 | 313 | 19 | 20 |
| MRAH.G10C-IgG2 | 327 | 313 | 19 | 20 |
| MRAH.L11C-IgG2 | 328 | 313 | 19 | 20 |
| MRAH.V12C-IgG2 | 329 | 313 | 19 | 20 |
| MRAH.R13C-IgG2 | 330 | 313 | 19 | 20 |
| MRAH.P14C-IgG2 | 331 | 313 | 19 | 20 |
| MRAH.S15C-IgG2 | 332 | 313 | 19 | 20 |
| MRAH.Q16C-IgG2 | 333 | 313 | 19 | 20 |
| MRAH.T17C-IgG2 | 334 | 313 | 19 | 20 |
| MRAH.L18C-IgG2 | 335 | 313 | 19 | 20 |
| MRAH.S19C-IgG2 | 336 | 313 | 19 | 20 |
| MRAH.L20C-IgG2 | 337 | 313 | 19 | 20 |
| MRAH.T21C-IgG2 | 338 | 313 | 19 | 20 |
| MRAH.T23C-IgG2 | 339 | 313 | 19 | 20 |
| MRAH.S25C-IgG2 | 340 | 313 | 19 | 20 |
| MRAH.G26C-IgG2 | 341 | 313 | 19 | 20 |
| MRAH.S28C-IgG2 | 342 | 313 | 19 | 20 |
| MRAH.T30C-IgG2 | 343 | 313 | 19 | 20 |
| MRAH.S31C-IgG2 | 344 | 313 | 19 | 20 |
| MRAH.W35C-IgG2 | 345 | 313 | 19 | 20 |
| MRAH.S35aC-IgG2 | 346 | 313 | 19 | 20 |
| MRAH.Y50C-IgG2 | 347 | 313 | 19 | 20 |
| MRAH.I51C-IgG2 | 348 | 313 | 19 | 20 |
| MRAH.S52C-IgG2 | 349 | 313 | 19 | 20 |
| MRAH.S62C-IgG2 | 350 | 313 | 19 | 20 |
| MRAH.L63C-IgG2 | 351 | 313 | 19 | 20 |
| MRAH.K64C-IgG2 | 352 | 313 | 19 | 20 |

TABLE 31-continued

| MRA-IgG2 heavy chain variant name | Heavy chain variable region SEQ ID NO: | Heavy chain constant region SEQ ID NO: | Light chain variable region SEQ ID NO: | Light chain constant region SEQ ID NO: |
|---|---|---|---|---|
| MRAH.S65C-IgG2 | 353 | 313 | 19 | 20 |
| MRAH.R66C-IgG2 | 354 | 313 | 19 | 20 |
| MRAH.V67C-IgG2 | 355 | 313 | 19 | 20 |
| MRAH.T68C-IgG2 | 356 | 313 | 19 | 20 |
| MRAH.L70C-IgG2 | 357 | 313 | 19 | 20 |
| MRAH.D72C-IgG2 | 358 | 313 | 19 | 20 |
| MRAH.T73C-IgG2 | 359 | 313 | 19 | 20 |
| MRAH.S74C-IgG2 | 360 | 313 | 19 | 20 |
| MRAH.K75C-IgG2 | 361 | 313 | 19 | 20 |
| MRAH.N76C-IgG2 | 362 | 313 | 19 | 20 |
| MRAH.Q77C-IgG2 | 363 | 313 | 19 | 20 |
| MRAH.S79C-IgG2 | 364 | 313 | 19 | 20 |
| MRAH.L80C-IgG2 | 365 | 313 | 19 | 20 |
| MRAH.R81C-IgG2 | 366 | 313 | 19 | 20 |
| MRAH.L82C-IgG2 | 367 | 313 | 19 | 20 |
| MRAH.S82aC-IgG2 | 368 | 313 | 19 | 20 |
| MRAH.S82bC-IgG2 | 369 | 313 | 19 | 20 |
| MRAH.V82cC-IgG2 | 370 | 313 | 19 | 20 |
| MRAH.D101C-IgG2 | 371 | 313 | 19 | 20 |
| MRAH.Y102C-IgG2 | 372 | 313 | 19 | 20 |
| MRAH.S112C-IgG2 | 373 | 313 | 19 | 20 |
| MRAH.S113C-IgG2 | 374 | 313 | 19 | 20 |
| G2d.A118C-IgG2 | 17 | 691 | 19 | 20 |
| G2d.S119C-IgG2 | 17 | 692 | 19 | 20 |
| G2d.T120C-IgG2 | 17 | 693 | 19 | 20 |
| G2d.K121C-IgG2 | 17 | 694 | 19 | 20 |
| G2d.G122C-IgG2 | 17 | 695 | 19 | 20 |
| G2d.P123C-IgG2 | 17 | 696 | 19 | 20 |
| G2d.S124C-IgG2 | 17 | 697 | 19 | 20 |
| G2d.V125C-IgG2 | 17 | 698 | 19 | 20 |
| G2d.F126C-IgG2 | 17 | 699 | 19 | 20 |
| G2d.P127C-IgG2 | 17 | 700 | 19 | 20 |
| G2d.S132C-IgG2 | 17 | 701 | 19 | 20 |
| G2d.R133C-IgG2 | 17 | 702 | 19 | 20 |
| G2d.S134C-IgG2 | 17 | 703 | 19 | 20 |
| G2d.T135C-IgG2 | 17 | 704 | 19 | 20 |
| G2d.S136C-IgG2 | 17 | 705 | 19 | 20 |
| G2d.E137C-IgG2 | 17 | 706 | 19 | 20 |
| G2d.S138C-IgG2 | 17 | 707 | 19 | 20 |
| G2d.T139C-IgG2 | 17 | 708 | 19 | 20 |
| G2d.A140C-IgG2 | 17 | 709 | 19 | 20 |
| G2d.A141C-IgG2 | 17 | 710 | 19 | 20 |
| G2d.D148C-IgG2 | 17 | 711 | 19 | 20 |
| G2d.Y149C-IgG2 | 17 | 712 | 19 | 20 |
| G2d.F150C-IgG2 | 17 | 713 | 19 | 20 |
| G2d.P151C-IgG2 | 17 | 714 | 19 | 20 |
| G2d.E152C-IgG2 | 17 | 715 | 19 | 20 |
| G2d.P153C-IgG2 | 17 | 716 | 19 | 20 |
| G2d.V154C-IgG2 | 17 | 717 | 19 | 20 |
| G2d.T155C-IgG2 | 17 | 718 | 19 | 20 |
| G2d.V156C-IgG2 | 17 | 719 | 19 | 20 |
| G2d.S157C-IgG2 | 17 | 720 | 19 | 20 |
| G2d.W158C-IgG2 | 17 | 721 | 19 | 20 |
| G2d.N159C-IgG2 | 17 | 722 | 19 | 20 |
| G2d.S160C-IgG2 | 17 | 723 | 19 | 20 |
| G2d.G161C-IgG2 | 17 | 724 | 19 | 20 |
| G2d.A162C-IgG2 | 17 | 725 | 19 | 20 |
| G2d.L163C-IgG2 | 17 | 726 | 19 | 20 |
| G2d.T164C-IgG2 | 17 | 727 | 19 | 20 |
| G2d.S165C-IgG2 | 17 | 728 | 19 | 20 |
| G2d.G166C-IgG2 | 17 | 729 | 19 | 20 |
| G2d.V167C-IgG2 | 17 | 730 | 19 | 20 |
| G2d.V173C-IgG2 | 17 | 731 | 19 | 20 |
| G2d.L174C-IgG2 | 17 | 732 | 19 | 20 |
| G2d.Q175C-IgG2 | 17 | 733 | 19 | 20 |
| G2d.S176C-IgG2 | 17 | 734 | 19 | 20 |
| G2d.S177C-IgG2 | 17 | 735 | 19 | 20 |
| G2d.G178C-IgG2 | 17 | 736 | 19 | 20 |
| G2d.L179C-IgG2 | 17 | 737 | 19 | 20 |
| G2d.Y180C-IgG2 | 17 | 738 | 19 | 20 |
| G2d.V186C-IgG2 | 17 | 739 | 19 | 20 |
| G2d.T187C-IgG2 | 17 | 740 | 19 | 20 |
| G2d.V188C-IgG2 | 17 | 741 | 19 | 20 |
| G2d.P189C-IgG2 | 17 | 742 | 19 | 20 |
| G2d.S190C-IgG2 | 17 | 743 | 19 | 20 |
| G2d.S191C-IgG2 | 17 | 744 | 19 | 20 |
| G2d.N192C-IgG2 | 17 | 745 | 19 | 20 |
| G2d.F193C-IgG2 | 17 | 746 | 19 | 20 |
| G2d.G194C-IgG2 | 17 | 747 | 19 | 20 |
| G2d.T195C-IgG2 | 17 | 748 | 19 | 20 |
| G2d.Q196C-IgG2 | 17 | 749 | 19 | 20 |
| G2d.T197C-IgG2 | 17 | 750 | 19 | 20 |
| G2d.Y198C-IgG2 | 17 | 751 | 19 | 20 |
| G2d.T199C-IgG2 | 17 | 752 | 19 | 20 |
| G2d.N201C-IgG2 | 17 | 753 | 19 | 20 |
| G2d.V202C-IgG2 | 17 | 754 | 19 | 20 |
| G2d.D203C-IgG2 | 17 | 755 | 19 | 20 |
| G2d.H204C-IgG2 | 17 | 756 | 19 | 20 |
| G2d.K205C-IgG2 | 17 | 757 | 19 | 20 |
| G2d.P206C-IgG2 | 17 | 758 | 19 | 20 |
| G2d.S207C-IgG2 | 17 | 759 | 19 | 20 |
| G2d.N208C-IgG2 | 17 | 760 | 19 | 20 |
| G2d.T209C-IgG2 | 17 | 761 | 19 | 20 |
| G2d.K210C-IgG2 | 17 | 762 | 19 | 20 |
| G2d.V211C-IgG2 | 17 | 763 | 19 | 20 |
| G2d.D212C-IgG2 | 17 | 764 | 19 | 20 |
| G2d.K213C-IgG2 | 17 | 765 | 19 | 20 |
| G2d.T214C-IgG2 | 17 | 766 | 19 | 20 |
| G2d.V215C-IgG2 | 17 | 767 | 19 | 20 |
| G2d.E216C-IgG2 | 17 | 768 | 19 | 20 |
| G2d.R217C-IgG2 | 17 | 769 | 19 | 20 |
| G2d.K218C-IgG2 | 17 | 770 | 19 | 20 |

TABLE 32

| MRA-IgG2 light chain variant name | Heavy chain variable region SEQ ID NO: | Heavy chain constant region SEQ ID NO: | Light chain variable region SEQ ID NO: | Light chain constant region SEQ ID NO: |
|---|---|---|---|---|
| MRAL.T5C-IgG2 | 17 | 313 | 457 | 20 |
| MRAL.Q6C-IgG2 | 17 | 313 | 458 | 20 |
| MRAL.S7C-IgG2 | 17 | 313 | 459 | 20 |
| MRAL.P8C-IgG2 | 17 | 313 | 460 | 20 |
| MRAL.S9C-IgG2 | 17 | 313 | 461 | 20 |
| MRAL.S10C-IgG2 | 17 | 313 | 462 | 20 |
| MRAL.L11C-IgG2 | 17 | 313 | 463 | 20 |
| MRAL.S12C-IgG2 | 17 | 313 | 464 | 20 |
| MRAL.A13C-IgG2 | 17 | 313 | 465 | 20 |
| MRAL.S14C-IgG2 | 17 | 313 | 466 | 20 |
| MRAL.V15C-IgG2 | 17 | 313 | 467 | 20 |
| MRAL.G16C-IgG2 | 17 | 313 | 468 | 20 |
| MRAL.D17C-IgG2 | 17 | 313 | 469 | 20 |
| MRAL.R18C-IgG2 | 17 | 313 | 470 | 20 |
| MRAL.V19C-IgG2 | 17 | 313 | 471 | 20 |
| MRAL.T20C-IgG2 | 17 | 313 | 472 | 20 |
| MRAL.I21C-IgG2 | 17 | 313 | 473 | 20 |
| MRAL.T22C-IgG2 | 17 | 313 | 474 | 20 |
| MRAL.A25C-IgG2 | 17 | 313 | 475 | 20 |
| MRAL.S26C-IgG2 | 17 | 313 | 476 | 20 |
| MRAL.Q27C-IgG2 | 17 | 313 | 477 | 20 |
| MRAL.Y32C-IgG2 | 17 | 313 | 478 | 20 |
| MRAL.L33C-IgG2 | 17 | 313 | 479 | 20 |
| MRAL.N34C-IgG2 | 17 | 313 | 480 | 20 |
| MRAL.Y50C-IgG2 | 17 | 313 | 481 | 20 |
| MRAL.T51C-IgG2 | 17 | 313 | 482 | 20 |
| MRAL.H55C-IgG2 | 17 | 313 | 483 | 20 |
| MRAL.S56C-IgG2 | 17 | 313 | 484 | 20 |
| MRAL.G57C-IgG2 | 17 | 313 | 485 | 20 |
| MRAL.V58C-IgG2 | 17 | 313 | 486 | 20 |
| MRAL.P59C-IgG2 | 17 | 313 | 487 | 20 |

TABLE 32-continued

| MRA-IgG2 light chain variant name | Heavy chain variable region SEQ ID NO: | Heavy chain constant region SEQ ID NO: | Light chain variable region SEQ ID NO: | Light chain constant region SEQ ID NO: |
|---|---|---|---|---|
| MRAL.S60C-IgG2 | 17 | 313 | 488 | 20 |
| MRAL.R61C-IgG2 | 17 | 313 | 489 | 20 |
| MRAL.F62C-IgG2 | 17 | 313 | 490 | 20 |
| MRAL.S63C-IgG2 | 17 | 313 | 491 | 20 |
| MRAL.S65C-IgG2 | 17 | 313 | 492 | 20 |
| MRAL.S67C-IgG2 | 17 | 313 | 493 | 20 |
| MRAL.G68C-IgG2 | 17 | 313 | 494 | 20 |
| MRAL.T69C-IgG2 | 17 | 313 | 495 | 20 |
| MRAL.D70C-IgG2 | 17 | 313 | 496 | 20 |
| MRAL.T72C-IgG2 | 17 | 313 | 497 | 20 |
| MRAL.F73C-IgG2 | 17 | 313 | 498 | 20 |
| MRAL.T74C-IgG2 | 17 | 313 | 499 | 20 |
| MRAL.I75C-IgG2 | 17 | 313 | 500 | 20 |
| MRAL.S76C-IgG2 | 17 | 313 | 501 | 20 |
| MRAL.S77C-IgG2 | 17 | 313 | 502 | 20 |
| MRAL.L78C-IgG2 | 17 | 313 | 503 | 20 |
| MRAL.Q79C-IgG2 | 17 | 313 | 504 | 20 |
| MRAL.Y96C-IgG2 | 17 | 313 | 505 | 20 |
| MRAL.T97C-IgG2 | 17 | 313 | 506 | 20 |
| MRAL.F98C-IgG2 | 17 | 313 | 507 | 20 |
| MRAL.G99C-IgG2 | 17 | 313 | 508 | 20 |
| MRAL.Q100C-IgG2 | 17 | 313 | 509 | 20 |
| MRAL.G101C-IgG2 | 17 | 313 | 510 | 20 |
| MRAL.T102C-IgG2 | 17 | 313 | 511 | 20 |
| MRAL.K103C-IgG2 | 17 | 313 | 512 | 20 |
| MRAL.V104C-IgG2 | 17 | 313 | 513 | 20 |
| MRAL.E105C-IgG2 | 17 | 313 | 514 | 20 |
| MRAL.I106C-IgG2 | 17 | 313 | 515 | 20 |
| MRAL.K107C-IgG2 | 17 | 313 | 516 | 20 |
| k0.R108C-IgG2 | 17 | 313 | 19 | 517 |
| k0.T109C-IgG2 | 17 | 313 | 19 | 518 |
| k0.V110C-IgG2 | 17 | 313 | 19 | 519 |
| k0.A111C-IgG2 | 17 | 313 | 19 | 520 |
| k0.A112C-IgG2 | 17 | 313 | 19 | 521 |
| k0.P113C-IgG2 | 17 | 313 | 19 | 522 |
| k0.S114C-IgG2 | 17 | 313 | 19 | 523 |
| k0.V115C-IgG2 | 17 | 313 | 19 | 524 |
| k0.F116C-IgG2 | 17 | 313 | 19 | 525 |
| k0.P120C-IgG2 | 17 | 313 | 19 | 526 |
| k0.S121C-IgG2 | 17 | 313 | 19 | 527 |
| k0.D122C-IgG2 | 17 | 313 | 19 | 528 |
| k0.E123C-IgG2 | 17 | 313 | 19 | 529 |
| k0.Q124C-IgG2 | 17 | 313 | 19 | 530 |
| k0.L125C-IgG2 | 17 | 313 | 19 | 531 |
| k0.K126C-IgG2 | 17 | 313 | 19 | 532 |
| k0.S127C-IgG2 | 17 | 313 | 19 | 533 |
| k0.G128C-IgG2 | 17 | 313 | 19 | 534 |
| k0.T129C-IgG2 | 17 | 313 | 19 | 535 |
| k0.A130C-IgG2 | 17 | 313 | 19 | 536 |
| k0.S131C-IgG2 | 17 | 313 | 19 | 537 |
| k0.L136C-IgG2 | 17 | 313 | 19 | 538 |
| k0.N137C-IgG2 | 17 | 313 | 19 | 539 |
| k0.N138C-IgG2 | 17 | 313 | 19 | 540 |
| k0.F139C-IgG2 | 17 | 313 | 19 | 541 |
| k0.Y140C-IgG2 | 17 | 313 | 19 | 542 |
| k0.P141C-IgG2 | 17 | 313 | 19 | 543 |
| k0.R142C-IgG2 | 17 | 313 | 19 | 544 |
| k0.E143C-IgG2 | 17 | 313 | 19 | 545 |
| k0.A144C-IgG2 | 17 | 313 | 19 | 546 |
| k0.K145C-IgG2 | 17 | 313 | 19 | 547 |
| k0.V146C-IgG2 | 17 | 313 | 19 | 548 |
| k0.Q147C-IgG2 | 17 | 313 | 19 | 549 |
| k0.W148C-IgG2 | 17 | 313 | 19 | 550 |
| k0.K149C-IgG2 | 17 | 313 | 19 | 551 |
| k0.V150C-IgG2 | 17 | 313 | 19 | 552 |
| k0.D151C-IgG2 | 17 | 313 | 19 | 553 |
| k0.N152C-IgG2 | 17 | 313 | 19 | 554 |
| k0.A153C-IgG2 | 17 | 313 | 19 | 555 |
| k0.L154C-IgG2 | 17 | 313 | 19 | 556 |
| k0.Q155C-IgG2 | 17 | 313 | 19 | 557 |
| k0.S156C-IgG2 | 17 | 313 | 19 | 558 |
| k0.G157C-IgG2 | 17 | 313 | 19 | 559 |
| k0.N158C-IgG2 | 17 | 313 | 19 | 560 |
| k0.S159C-IgG2 | 17 | 313 | 19 | 561 |
| k0.Q160C-IgG2 | 17 | 313 | 19 | 562 |
| k0.E161C-IgG2 | 17 | 313 | 19 | 563 |
| k0.S162C-IgG2 | 17 | 313 | 19 | 564 |
| k0.V163C-IgG2 | 17 | 313 | 19 | 565 |
| k0.T164C-IgG2 | 17 | 313 | 19 | 566 |
| k0.E165C-IgG2 | 17 | 313 | 19 | 567 |
| k0.Q166C-IgG2 | 17 | 313 | 19 | 568 |
| k0.D167C-IgG2 | 17 | 313 | 19 | 569 |
| k0.S168C-IgG2 | 17 | 313 | 19 | 570 |
| k0.K169C-IgG2 | 17 | 313 | 19 | 571 |
| k0.D170C-IgG2 | 17 | 313 | 19 | 572 |
| k0.S171C-IgG2 | 17 | 313 | 19 | 573 |
| k0.T172C-IgG2 | 17 | 313 | 19 | 574 |
| k0.Y173C-IgG2 | 17 | 313 | 19 | 575 |
| k0.S174C-IgG2 | 17 | 313 | 19 | 576 |
| k0.L175C-IgG2 | 17 | 313 | 19 | 577 |
| k0.T180C-IgG2 | 17 | 313 | 19 | 578 |
| k0.L181C-IgG2 | 17 | 313 | 19 | 579 |
| k0.S182C-IgG2 | 17 | 313 | 19 | 580 |
| k0.K183C-IgG2 | 17 | 313 | 19 | 581 |
| k0.A184C-IgG2 | 17 | 313 | 19 | 582 |
| k0.D185C-IgG2 | 17 | 313 | 19 | 583 |
| k0.Y186C-IgG2 | 17 | 313 | 19 | 584 |
| k0.E187C-IgG2 | 17 | 313 | 19 | 585 |
| k0.K188C-IgG2 | 17 | 313 | 19 | 586 |
| k0.H189C-IgG2 | 17 | 313 | 19 | 587 |
| k0.K190C-IgG2 | 17 | 313 | 19 | 588 |
| k0.V191C-IgG2 | 17 | 313 | 19 | 589 |
| k0.Y192C-IgG2 | 17 | 313 | 19 | 590 |
| k0.A193C-IgG2 | 17 | 313 | 19 | 591 |
| k0.E195C-IgG2 | 17 | 313 | 19 | 592 |
| k0.V196C-IgG2 | 17 | 313 | 19 | 593 |
| k0.T197C-IgG2 | 17 | 313 | 19 | 594 |
| k0.H198C-IgG2 | 17 | 313 | 19 | 595 |
| k0.Q199C-IgG2 | 17 | 313 | 19 | 596 |
| k0.G200C-IgG2 | 17 | 313 | 19 | 597 |
| k0.L201C-IgG2 | 17 | 313 | 19 | 598 |
| k0.S202C-IgG2 | 17 | 313 | 19 | 599 |
| k0.S203C-IgG2 | 17 | 313 | 19 | 600 |
| k0.P204C-IgG2 | 17 | 313 | 19 | 601 |
| k0.V205C-IgG2 | 17 | 313 | 19 | 602 |
| k0.T206C-IgG2 | 17 | 313 | 19 | 603 |
| k0.K207C-IgG2 | 17 | 313 | 19 | 604 |
| k0.S208C-IgG2 | 17 | 313 | 19 | 605 |
| k0.F209C-IgG2 | 17 | 313 | 19 | 606 |
| k0.N210C-IgG2 | 17 | 313 | 19 | 607 |
| k0.R211C-IgG2 | 17 | 313 | 19 | 608 |
| k0.G212C-IgG2 | 17 | 313 | 19 | 609 |
| k0.E213C-IgG2 | 17 | 313 | 19 | 610 |

Example 10$^{-2}$ Assessment of Electrophoretic Mobility in Pglyacrylamide Gel of Antibodies Having Cysteine Substitution at Various Positions of IgG2

Similarly to Example 8-2, non-reducing SDS-PAGE was carried out with the MRA-IgG2 variants produced in Example 10$^{-1}$, the gel image was captured, and bands were analyzed.

From the obtained gel image, the variants were classified into 7 groups according to the band pattern of each of the MRA-IgG2 variants: Single (one band at a molecular weight region near 140 kDa), Double (two bands at a molecular weight region near 140 kDa), Triple (three bands at a molecular weight region near 140 kDa), Several (four or more bands at a molecular weight region near 140 kDa), LMW (band(s) at a molecular weight region lower than near 140 kDa), HMW (band(s) at a molecular weight region higher than near 140 kDa), and Faint (band(s) blurry and difficult to determine). Grouping results of the band patterns for MRA-IgG2 heavy chain variants and MRA-IgG2 light chain variants are respectively shown in Tables 33 and 34. From Tables 33 and 34, variants classified into the Double and Triple groups are shown in Table 35. It is noted that while Table 34 indicates "no data" for MRAL.K107C-IgG2, position 107 (Kabat numbering), which is the position of cysteine substitution in this variant, is a position where the residue structurally exposed to the surface is present in the hinge region. Accordingly, this variant may also be classified as "Double".

TABLE 33

| MRA-IgG2 heavy chain variant name | Group |
|---|---|
| MRAH.Q5C-IgG2 | Double |
| MRAH.E6C-IgG2 | Double |
| MRAH.S7C-IgG2 | Faint |
| MRAH.G8C-IgG2 | Double |
| MRAH.P9C-IgG2 | Double |
| MRAH.G10C-IgG2 | Double |
| MRAH.L11C-IgG2 | Double |
| MRAH.V12C-IgG2 | Double |
| MRAH.R13C-IgG2 | Double |
| MRAH.P14C-IgG2 | Double |
| MRAH.S15C-IgG2 | Double |
| MRAH.Q16C-IgG2 | Double |
| MRAH.T17C-IgG2 | Double |
| MRAH.L18C-IgG2 | Faint |
| MRAH.S19C-IgG2 | Double |
| MRAH.L20C-IgG2 | Faint |
| MRAH.T21C-IgG2 | Double |
| MRAH.T23C-IgG2 | Double |
| MRAH.S25C-IgG2 | Double |
| MRAH.G26C-IgG2 | Double |
| MRAH.S28C-IgG2 | Double |
| MRAH.T30C-IgG2 | Double |
| MRAH.S31C-IgG2 | Double |
| MRAH.W35C-IgG2 | Double |
| MRAH.S35aC-IgG2 | Faint |
| MRAH.Y50C-IgG2 | Faint |
| MRAH.I51C-IgG2 | Double |
| MRAH.S52C-IgG2 | Double |
| MRAH.S62C-IgG2 | Double |
| MRAH.L63C-IgG2 | Double |
| MRAH.K64C-IgG2 | Double |
| MRAH.S65C-IgG2 | Double |
| MRAH.R66C-IgG2 | Double |
| MRAH.V67C-IgG2 | Faint |
| MRAH.T68C-IgG2 | Double |
| MRAH.L70C-IgG2 | Double |
| MRAH.D72C-IgG2 | Double |
| MRAH.T73C-IgG2 | Double |
| MRAH.S74C-IgG2 | HMW |
| MRAH.K75C-IgG2 | Double |
| MRAH.N76C-IgG2 | no data |
| MRAH.Q77C-IgG2 | Double |
| MRAH.S79C-IgG2 | Double |
| MRAH.L80C-IgG2 | Faint |
| MRAH.R81C-IgG2 | Double |
| MRAH.L82C-IgG2 | Faint |
| MRAH.S82aC-IgG2 | Double |
| MRAH.S82bC-IgG2 | Double |
| MRAH.V82cC-IgG2 | Faint |
| MRAH.D101C-IgG2 | Double |
| MRAH.Y102C-IgG2 | Double |
| MRAH.S112C-IgG2 | Double |
| MRAH.S113C-IgG2 | Double |
| G2d.A118C-IgG2 | LMW |
| G2d.S119C-IgG2 | Double |
| G2d.T120C-IgG2 | Double |
| G2d.K121C-IgG2 | Double |
| G2d.G122C-IgG2 | Double |
| G2d.P123C-IgG2 | LMW |

TABLE 33-continued

| MRA-IgG2 heavy chain variant name | Group |
|---|---|
| G2d.S124C-IgG2 | Double |
| G2d.V125C-IgG2 | LMW |
| G2d.F126C-IgG2 | Double |
| G2d.P127C-IgG2 | Faint |
| G2d.S132C-IgG2 | Double |
| G2d.R133C-IgG2 | Double |
| G2d.S134C-IgG2 | Double |
| G2d.T135C-IgG2 | Double |
| G2d.S136C-IgG2 | Double |
| G2d.E137C-IgG2 | Double |
| G2d.S138C-IgG2 | Double |
| G2d.T139C-IgG2 | Faint |
| G2d.A140C-IgG2 | Double |
| G2d.A141C-IgG2 | Faint |
| G2d.D148C-IgG2 | Double |
| G2d.Y149C-IgG2 | Double |
| G2d.F150C-IgG2 | LMW |
| G2d.P151C-IgG2 | no data |
| G2d.E152C-IgG2 | LMW |
| G2d.P153C-IgG2 | HMW |
| G2d.V154C-IgG2 | Faint |
| G2d.T155C-IgG2 | Double |
| G2d.V156C-IgG2 | Double |
| G2d.S157C-IgG2 | no data |
| G2d.W158C-IgG2 | no data |
| G2d.N159C-IgG2 | Double |
| G2d.S160C-IgG2 | Double |
| G2d.G161C-IgG2 | Double |
| G2d.A162C-IgG2 | Double |
| G2d.L163C-IgG2 | Double |
| G2d.T164C-IgG2 | Double |
| G2d.S165C-IgG2 | LMW |
| G2d.G166C-IgG2 | Faint |
| G2d.V167C-IgG2 | Double |
| G2d.V173C-IgG2 | Double |
| G2d.L174C-IgG2 | LMW |
| G2d.Q175C-IgG2 | Double |
| G2d.S176C-IgG2 | Double |
| G2d.S177C-IgG2 | Double |
| G2d.G178C-IgG2 | Double |
| G2d.L179C-IgG2 | Double |
| G2d.Y180C-IgG2 | LMW |
| G2d.V186C-IgG2 | LMW |
| G2d.T187C-IgG2 | Double |
| G2d.V188C-IgG2 | Double |
| G2d.P189C-IgG2 | Double |
| G2d.S190C-IgG2 | Double |
| G2d.S191C-IgG2 | Double |
| G2d.N192C-IgG2 | Double |
| G2d.F193C-IgG2 | Double |
| G2d.G194C-IgG2 | Double |
| G2d.T195C-IgG2 | Double |
| G2d.Q196C-IgG2 | Double |
| G2d.T197C-IgG2 | Double |
| G2d.Y198C-IgG2 | LMW |
| G2d.T199C-IgG2 | LMW |
| G2d.N201C-IgG2 | LMW |
| G2d.V202C-IgG2 | LMW |
| G2d.D203C-IgG2 | LMW |
| G2d.H204C-IgG2 | LMW |
| G2d.K205C-IgG2 | LMW |
| G2d.P206C-IgG2 | LMW |
| G2d.S207C-IgG2 | LMW |
| G2d.N208C-IgG2 | Double |
| G2d.T209C-IgG2 | Double |
| G2d.K210C-IgG2 | Double |
| G2d.V211C-IgG2 | Double |
| G2d.D212C-IgG2 | Double |
| G2d.K213C-IgG2 | Double |
| G2d.T214C-IgG2 | Single |
| G2d.V215C-IgG2 | Single |
| G2d.E216C-IgG2 | Single |
| G2d.R217C-IgG2 | Double |
| G2d.K218C-IgG2 | Double |

TABLE 34

| MRA-IgG2 light chain variant name | Group |
|---|---|
| MRAL.T5C-IgG2 | Double |
| MRAL.Q6C-IgG2 | Faint |
| MRAL.S7C-IgG2 | Double |
| MRAL.P8C-IgG2 | no data |
| MRAL.S9C-IgG2 | Double |
| MRAL.S10C-IgG2 | Double |
| MRAL.L11C-IgG2 | Double |
| MRAL.S12C-IgG2 | Double |
| MRAL.A13C-IgG2 | Double |
| MRAL.S14C-IgG2 | Double |
| MRAL.V15C-IgG2 | Double |
| MRAL.G16C-IgG2 | Double |
| MRAL.D17C-IgG2 | Double |
| MRAL.R18C-IgG2 | Double |
| MRAL.V19C-IgG2 | Double |
| MRAL.T20C-IgG2 | Double |
| MRAL.I21C-IgG2 | Double |
| MRAL.T22C-IgG2 | Double |
| MRAL.A25C-IgG2 | Faint |
| MRAL.S26C-IgG2 | Double |
| MRAL.Q27C-IgG2 | Double |
| MRAL.Y32C-IgG2 | Double |
| MRAL.L33C-IgG2 | Faint |
| MRAL.N34C-IgG2 | Faint |
| MRAL.Y50C-IgG2 | Double |
| MRAL.T51C-IgG2 | Double |
| MRAL.H55C-IgG2 | Double |
| MRAL.S56C-IgG2 | Double |
| MRAL.G57C-IgG2 | Double |
| MRAL.V58C-IgG2 | Double |
| MRAL.P59C-IgG2 | Double |
| MRAL.S60C-IgG2 | Double |
| MRAL.R61C-IgG2 | Double |
| MRAL.F62C-IgG2 | Faint |
| MRAL.S63C-IgG2 | Double |
| MRAL.S65C-IgG2 | Double |
| MRAL.S67C-IgG2 | Double |
| MRAL.G68C-IgG2 | Double |
| MRAL.T69C-IgG2 | Double |
| MRAL.D70C-IgG2 | Double |
| MRAL.T72C-IgG2 | Double |
| MRAL.F73C-IgG2 | Faint |
| MRAL.T74C-IgG2 | Double |
| MRAL.I75C-IgG2 | no data |
| MRAL.S76C-IgG2 | Double |
| MRAL.S77C-IgG2 | Double |
| MRAL.L78C-IgG2 | Faint |
| MRAL.Q79C-IgG2 | Double |
| MRAL.Y96C-IgG2 | Faint |
| MRAL.T97C-IgG2 | Double |
| MRAL.F98C-IgG2 | Faint |
| MRAL.G99C-IgG2 | Double |
| MRAL.Q100C-IgG2 | Double |
| MRAL.G101C-IgG2 | Double |
| MRAL.T102C-IgG2 | Faint |
| MRAL.K103C-IgG2 | Double |
| MRAL.V104C-IgG2 | Faint |
| MRAL.E105C-IgG2 | Double |
| MRAL.I106C-IgG2 | Faint |
| MRAL.K107C-IgG2 | no data |
| k0.R108C-IgG2 | Double |
| k0.T109C-IgG2 | Double |
| k0.V110C-IgG2 | Double |
| k0.A111C-IgG2 | Double |
| k0.A112C-IgG2 | Double |
| k0.P113C-IgG2 | Double |
| k0.S114C-IgG2 | Double |
| k0.V115C-IgG2 | Faint |
| k0.F116C-IgG2 | Double |
| k0.P120C-IgG2 | Faint |
| k0.S121C-IgG2 | Faint |
| k0.D122C-IgG2 | LMW |
| k0.E123C-IgG2 | Double |
| k0.Q124C-IgG2 | Faint |
| k0.L125C-IgG2 | Double |
| k0.K126C-IgG2 | Triple |
| k0.S127C-IgG2 | Double |

TABLE 34-continued

| MRA-IgG2 light chain variant name | Group |
|---|---|
| k0.G128C-IgG2 | Double |
| k0.T129C-IgG2 | Double |
| k0.A130C-IgG2 | Faint |
| k0.S131C-IgG2 | Faint |
| k0.L136C-IgG2 | Faint |
| k0.N137C-IgG2 | no data |
| k0.N138C-IgG2 | Double |
| k0.F139C-IgG2 | Faint |
| k0.Y140C-IgG2 | Faint |
| k0.P141C-IgG2 | Double |
| k0.R142C-IgG2 | Double |
| k0.E143C-IgG2 | Double |
| k0.A144C-IgG2 | Double |
| k0.K145C-IgG2 | Double |
| k0.V146C-IgG2 | Faint |
| k0.Q147C-IgG2 | Double |
| k0.W148C-IgG2 | no data |
| k0.K149C-IgG2 | Double |
| k0.V150C-IgG2 | Faint |
| k0.D151C-IgG2 | Double |
| k0.N152C-IgG2 | Double |
| k0.A153C-IgG2 | Double |
| k0.L154C-IgG2 | Double |
| k0.Q155C-IgG2 | Double |
| k0.S156C-IgG2 | Double |
| k0.G157C-IgG2 | Double |
| k0.N158C-IgG2 | Double |
| k0.S159C-IgG2 | Double |
| k0.Q160C-IgG2 | Double |
| k0.E161C-IgG2 | Double |
| k0.S162C-IgG2 | Double |
| k0.V163C-IgG2 | Double |
| k0.T164C-IgG2 | Double |
| k0.E165C-IgG2 | Double |
| k0.Q166C-IgG2 | Double |
| k0.D167C-IgG2 | Double |
| k0.S168C-IgG2 | Double |
| k0.K169C-IgG2 | Double |
| k0.D170C-IgG2 | Double |
| k0.S171C-IgG2 | Double |
| k0.T172C-IgG2 | Double |
| k0.Y173C-IgG2 | Faint |
| k0.S174C-IgG2 | Faint |
| k0.L175C-IgG2 | Faint |
| k0.T180C-IgG2 | Double |
| k0.L181C-IgG2 | Double |
| k0.S182C-IgG2 | Double |
| k0.K183C-IgG2 | Double |
| k0.A184C-IgG2 | Double |
| k0.D185C-IgG2 | Double |
| k0.Y186C-IgG2 | Double |
| k0.E187C-IgG2 | LMW |
| k0.K188C-IgG2 | Double |
| k0.H189C-IgG2 | Faint |
| k0.K190C-IgG2 | LMW |
| k0.V191C-IgG2 | Double |
| k0.Y192C-IgG2 | Double |
| k0.A193C-IgG2 | Double |
| k0.E195C-IgG2 | Double |
| k0.V196C-IgG2 | Double |
| k0.T197C-IgG2 | Double |
| k0.H198C-IgG2 | Faint |
| k0.Q199C-IgG2 | Double |
| k0.G200C-IgG2 | Triple |
| k0.L201C-IgG2 | Triple |
| k0.S202C-IgG2 | Double |
| k0.S203C-IgG2 | Triple |
| k0.P204C-IgG2 | Double |
| k0.V205C-IgG2 | Triple |
| k0.T206C-IgG2 | Double |
| k0.K207C-IgG2 | Triple |
| k0.S208C-IgG2 | Double |
| k0.F209C-IgG2 | LMW |

TABLE 34-continued

| MRA-IgG2 light chain variant name | Group |
|---|---|
| k0.N210C-IgG2 | LMW |
| k0.R211C-IgG2 | LMW |
| k0.G212C-IgG2 | Double |
| k0.E213C-IgG2 | Double |

TABLE 35

| MRA-IgG2 variant name | Group |
|---|---|
| MRAH.Q5C-IgG2 | Double |
| MRAH.E6C-IgG2 | Double |
| MRAH.G8C-IgG2 | Double |
| MRAH.P9C-IgG2 | Double |
| MRAH.G10C-IgG2 | Double |
| MRAH.L11C-IgG2 | Double |
| MRAH.V12C-IgG2 | Double |
| MRAH.R13C-IgG2 | Double |
| MRAH.P14C-IgG2 | Double |
| MRAH.S15C-IgG2 | Double |
| MRAH.Q16C-IgG2 | Double |
| MRAH.T17C-IgG2 | Double |
| MRAH.S19C-IgG2 | Double |
| MRAH.T21C-IgG2 | Double |
| MRAH.T23C-IgG2 | Double |
| MRAH.S25C-IgG2 | Double |
| MRAH.G26C-IgG2 | Double |
| MRAH.S28C-IgG2 | Double |
| MRAH.T30C-IgG2 | Double |
| MRAH.S31C-IgG2 | Double |
| MRAH.W35C-IgG2 | Double |
| MRAH.I51C-IgG2 | Double |
| MRAH.S52C-IgG2 | Double |
| MRAH.S62C-IgG2 | Double |
| MRAH.L63C-IgG2 | Double |
| MRAH.K64C-IgG2 | Double |
| MRAH.S65C-IgG2 | Double |
| MRAH.R66C-IgG2 | Double |
| MRAH.T68C-IgG2 | Double |
| MRAH.L70C-IgG2 | Double |
| MRAH.D72C-IgG2 | Double |
| MRAH.T73C-IgG2 | Double |
| MRAH.K75C-IgG2 | Double |
| MRAH.Q77C-IgG2 | Double |
| MRAH.S79C-IgG2 | Double |
| MRAH.R81C-IgG2 | Double |
| MRAH.S82aC-IgG2 | Double |
| MRAH.S82bC-IgG2 | Double |
| MRAH.D101C-IgG2 | Double |
| MRAH.Y102C-IgG2 | Double |
| MRAH.S112C-IgG2 | Double |
| MRAH.S113C-IgG2 | Double |
| G2d.S119C-IgG2 | Double |
| G2d.T120C-IgG2 | Double |
| G2d.K121C-IgG2 | Double |
| G2d.G122C-IgG2 | Double |
| G2d.S124C-IgG2 | Double |
| G2d.F126C-IgG2 | Double |
| G2d.S132C-IgG2 | Double |
| G2d.R133C-IgG2 | Double |
| G2d.S134C-IgG2 | Double |
| G2d.T135C-IgG2 | Double |
| G2d.S136C-IgG2 | Double |
| G2d.E137C-IgG2 | Double |
| G2d.S138C-IgG2 | Double |
| G2d.A140C-IgG2 | Double |
| G2d.D148C-IgG2 | Double |
| G2d.Y149C-IgG2 | Double |
| G2d.T155C-IgG2 | Double |
| G2d.V156C-IgG2 | Double |
| G2d.N159C-IgG2 | Double |
| G2d.S160C-IgG2 | Double |
| G2d.G161C-IgG2 | Double |
| G2d.A162C-IgG2 | Double |

TABLE 35-continued

| MRA-IgG2 variant name | Group |
|---|---|
| G2d.L163C-IgG2 | Double |
| G2d.T164C-IgG2 | Double |
| G2d.V167C-IgG2 | Double |
| G2d.V173C-IgG2 | Double |
| G2d.Q175C-IgG2 | Double |
| G2d.S176C-IgG2 | Double |
| G2d.S177C-IgG2 | Double |
| G2d.G178C-IgG2 | Double |
| G2d.L179C-IgG2 | Double |
| G2d.T187C-IgG2 | Double |
| G2d.V188C-IgG2 | Double |
| G2d.P189C-IgG2 | Double |
| G2d.S190C-IgG2 | Double |
| G2d.S191C-IgG2 | Double |
| G2d.N192C-IgG2 | Double |
| G2d.F193C-IgG2 | Double |
| G2d.G194C-IgG2 | Double |
| G2d.T195C-IgG2 | Double |
| G2d.Q196C-IgG2 | Double |
| G2d.T197C-IgG2 | Double |
| G2d.N208C-IgG2 | Double |
| G2d.T209C-IgG2 | Double |
| G2d.K210C-IgG2 | Double |
| G2d.V211C-IgG2 | Double |
| G2d.D212C-IgG2 | Double |
| G2d.K213C-IgG2 | Double |
| G2d.R217C-IgG2 | Double |
| G2d.K218C-IgG2 | Double |
| MRAL.T5C-IgG2 | Double |
| MRAL.S7C-IgG2 | Double |
| MRAL.S9C-IgG2 | Double |
| MRAL.S10C-IgG2 | Double |
| MRAL.L11C-IgG2 | Double |
| MRAL.S12C-IgG2 | Double |
| MRAL.A13C-IgG2 | Double |
| MRAL.S14C-IgG2 | Double |
| MRAL.V15C-IgG2 | Double |
| MRAL.G16C-IgG2 | Double |
| MRAL.D17C-IgG2 | Double |
| MRAL.R18C-IgG2 | Double |
| MRAL.V19C-IgG2 | Double |
| MRAL.T20C-IgG2 | Double |
| MRAL.I21C-IgG2 | Double |
| MRAL.T22C-IgG2 | Double |
| MRAL.S26C-IgG2 | Double |
| MRAL.Q27C-IgG2 | Double |
| MRAL.Y32C-IgG2 | Double |
| MRAL.Y50C-IgG2 | Double |
| MRAL.T51C-IgG2 | Double |
| MRAL.H55C-IgG2 | Double |
| MRAL.S56C-IgG2 | Double |
| MRAL.G57C-IgG2 | Double |
| MRAL.V58C-IgG2 | Double |
| MRAL.P59C-IgG2 | Double |
| MRAL.S60C-IgG2 | Double |
| MRAL.R61C-IgG2 | Double |
| MRAL.S63C-IgG2 | Double |
| MRAL.S65C-IgG2 | Double |
| MRAL.S67C-IgG2 | Double |
| MRAL.G68C-IgG2 | Double |
| MRAL.T69C-IgG2 | Double |
| MRAL.D70C-IgG2 | Double |
| MRAL.T72C-IgG2 | Double |
| MRAL.T74C-IgG2 | Double |
| MRAL.S76C-IgG2 | Double |
| MRAL.S77C-IgG2 | Double |
| MRAL.Q79C-IgG2 | Double |
| MRAL.T97C-IgG2 | Double |
| MRAL.G99C-IgG2 | Double |
| MRAL.Q100C-IgG2 | Double |
| MRAL.G101C-IgG2 | Double |
| MRAL.K103C-IgG2 | Double |
| MRAL.E105C-IgG2 | Double |
| k0.R108C-IgG2 | Double |
| k0.T109C-IgG2 | Double |
| k0.V110C-IgG2 | Double |
| k0.A111C-IgG2 | Double |

TABLE 35-continued

| MRA-IgG2 variant name | Group |
|---|---|
| k0.A112C-IgG2 | Double |
| k0.P113C-IgG2 | Double |
| k0.S114C-IgG2 | Double |
| k0.F116C-IgG2 | Double |
| k0.E123C-IgG2 | Double |
| k0.L125C-IgG2 | Double |
| k0.K126C-IgG2 | Triple |
| k0.S127C-IgG2 | Double |
| k0.G128C-IgG2 | Double |
| k0.T129C-IgG2 | Double |
| k0.N138C-IgG2 | Double |
| k0.P141C-IgG2 | Double |
| k0.R142C-IgG2 | Double |
| k0.E143C-IgG2 | Double |
| k0.A144C-IgG2 | Double |
| k0.K145C-IgG2 | Double |
| k0.Q147C-IgG2 | Double |
| k0.K149C-IgG2 | Double |
| k0.D151C-IgG2 | Double |
| k0.N152C-IgG2 | Double |
| k0.A153C-IgG2 | Double |
| k0.L154C-IgG2 | Double |
| k0.Q155C-IgG2 | Double |
| k0.S156C-IgG2 | Double |
| k0.G157C-IgG2 | Double |
| k0.N158C-IgG2 | Double |
| k0.S159C-IgG2 | Double |
| k0.Q160C-IgG2 | Double |
| k0.E161C-IgG2 | Double |
| k0.S162C-IgG2 | Double |
| k0.V163C-IgG2 | Double |
| k0.T164C-IgG2 | Double |
| k0.E165C-IgG2 | Double |
| k0.Q166C-IgG2 | Double |
| k0.D167C-IgG2 | Double |
| k0.S168C-IgG2 | Double |
| k0.K169C-IgG2 | Double |
| k0.D170C-IgG2 | Double |
| k0.S171C-IgG2 | Double |
| k0.T172C-IgG2 | Double |
| k0.T180C-IgG2 | Double |
| k0.L181C-IgG2 | Double |
| k0.S182C-IgG2 | Double |
| k0.K183C-IgG2 | Double |
| k0.A184C-IgG2 | Double |
| k0.D185C-IgG2 | Double |
| k0.Y186C-IgG2 | Double |
| k0.K188C-IgG2 | Double |
| k0.V191C-IgG2 | Double |
| k0.Y192C-IgG2 | Double |
| k0.A193C-IgG2 | Double |
| k0.E195C-IgG2 | Double |
| k0.V196C-IgG2 | Double |
| k0.T197C-IgG2 | Double |
| k0.Q199C-IgG2 | Double |
| k0.G200C-IgG2 | Triple |
| k0.L201C-IgG2 | Triple |
| k0.S202C-IgG2 | Double |
| k0.S203C-IgG2 | Triple |
| k0.P204C-IgG2 | Double |
| k0.V205C-IgG2 | Triple |
| k0.T206C-IgG2 | Double |
| k0.K207C-IgG2 | Triple |
| k0.S208C-IgG2 | Double |
| k0.G212C-IgG2 | Double |
| k0.E213C-IgG2 | Double |

Example 11 Assessment of Antibodies Having Cysteine Substitution at Various Positions of the Lambda Chain

Example 11-1 Production of Antibodies Having Cysteine Substitution at Various Positions of the Lambda Chain The light chain (Lambda chain) of an anti-human CXCL10 neutralizing antibody, G7-IgG1 (heavy chain: G7H-G1T4 (SEQ ID NO: 314), light chain: G7L-LTO (SEQ ID NO: 316)), was subjected to a study in which an arbitrary amino acid residue structurally exposed to the surface was substituted with cysteine.

Amino acid residues within the G7-IgG1 light chain variable region (G7L, SEQ ID NO: 317) were substituted with cysteine to produce variants of the G7-IgG1 light chain variable region shown in Table 36. These variants of the G7-IgG1 light chain variable region were each linked with the G7-IgG1 light chain constant region (LTO, SEQ ID NO: 318) to produce G7-IgG1 light chain variants, and expression vectors encoding the corresponding genes were produced by a method known to the person skilled in the art. In addition, amino acid residues within the G7-IgG1 light chain constant region (LTO, SEQ ID NO: 318) were substituted with cysteine to produce variants of the G7-IgG1 light chain constant region shown in Table 37. These variants of the G7-IgG1 heavy chain constant region were each linked with the G7-IgG1 light chain variable region (G7L, SEQ ID NO: 317) to produce G7-IgG1 light chain variants, and expression vectors encoding the corresponding genes were produced by a method known to the person skilled in the art.

TABLE 36

| Variant of G7-IgG1 light chain variable region | Position of cysteine substitution (Kabat numbering) | SEQ ID NO: |
|---|---|---|
| G7L.T5C | 5 | 771 |
| G7L.Q6C | 6 | 772 |
| G7L.P7C | 7 | 773 |
| G7L.P8C | 8 | 774 |
| G7L.S9C | 9 | 775 |
| G7L.A11C | 11 | 776 |
| G7L.S12C | 12 | 777 |
| G7L.G13C | 13 | 778 |
| G7L.T14C | 14 | 779 |
| G7L.P15C | 15 | 780 |
| G7L.G16C | 16 | 781 |
| G7L.Q17C | 17 | 782 |
| G7L.R18C | 18 | 783 |
| G7L.V19C | 19 | 784 |
| G7L.T20C | 20 | 785 |
| G7L.I21C | 21 | 786 |
| G7L.S22C | 22 | 787 |
| G7L.G25C | 25 | 788 |
| G7L.S26C | 26 | 789 |
| G7L.S27C | 27 | 790 |
| G7L.S27aC | 27a | 791 |
| G7L.T32C | 32 | 792 |
| G7L.V33C | 33 | 793 |
| G7L.N34C | 34 | 794 |
| G7L.N50C | 50 | 795 |
| G7L.N51C | 51 | 796 |
| G7L.P55C | 55 | 797 |
| G7L.S56C | 56 | 798 |
| G7L.G57C | 57 | 799 |
| G7L.I58C | 58 | 800 |
| G7L.P59C | 59 | 801 |
| G7L.D60C | 60 | 802 |
| G7L.R61C | 61 | 803 |
| G7L.F62C | 62 | 804 |
| G7L.S63C | 63 | 805 |

TABLE 36-continued

| Variant of G7-IgG1 light chain variable region | Position of cysteine substitution (Kabat numbering) | SEQ ID NO: |
|---|---|---|
| G7L.S65C | 65 | 806 |
| G7L.S67C | 67 | 807 |
| G7L.G68C | 68 | 808 |
| G7L.T69C | 69 | 809 |
| G7L.S70C | 70 | 810 |
| G7L.S72C | 72 | 811 |
| G7L.L73C | 73 | 812 |
| G7L.V74C | 74 | 813 |
| G7L.I75C | 75 | 814 |
| G7L.S76C | 76 | 815 |
| G7L.G77C | 77 | 816 |
| G7L.L78C | 78 | 817 |
| G7L.Q79C | 79 | 818 |
| G7L.R96C | 96 | 819 |
| G7L.V97C | 97 | 820 |
| G7L.F98C | 98 | 821 |
| G7L.G99C | 99 | 822 |
| G7L.G100C | 100 | 823 |
| G7L.G101C | 101 | 824 |
| G7L.T102C | 102 | 825 |
| G7L.K103C | 103 | 826 |
| G7L.L104C | 104 | 827 |
| G7L.T105C | 105 | 828 |
| G7L.V106C | 106 | 829 |
| G7L.L106aC | 106a | 830 |

TABLE 37

| Variant of G7-IgG1 light chain constant region | Position of cysteine substitution (Rabat numbering) | SEQ ID NO: |
|---|---|---|
| LT0.Q108C | 108 | 831 |
| LT0.P109C | 109 | 832 |
| LT0.K110C | 110 | 833 |
| LT0.A111C | 111 | 834 |
| LT0.A112C | 112 | 835 |
| LT0.P113C | 113 | 836 |
| LT0.S114C | 114 | 837 |
| LT0.V115C | 115 | 838 |
| LT0.T116C | 116 | 839 |
| LT0.P120C | 120 | 840 |
| LT0.S121C | 121 | 841 |
| LT0.S122C | 122 | 842 |
| LT0.E123C | 123 | 843 |
| LT0.E124C | 124 | 844 |
| LT0.L125C | 125 | 845 |
| LT0.Q126C | 126 | 846 |
| LT0.A127C | 127 | 847 |
| LT0.N128C | 128 | 848 |
| LT0.K129C | 129 | 849 |
| LT0.A130C | 130 | 850 |
| LT0.T131C | 131 | 851 |
| LT0.I136C | 136 | 852 |
| LT0.S137C | 137 | 853 |
| LT0.D138C | 138 | 854 |
| LT0.F139C | 139 | 855 |
| LT0.Y140C | 140 | 856 |
| LT0.P141C | 141 | 857 |
| LT0.G142C | 142 | 858 |
| LT0.A143C | 143 | 859 |
| LT0.V144C | 144 | 860 |
| LT0.T145C | 145 | 861 |
| LT0.V146C | 146 | 862 |
| LT0.A147C | 147 | 863 |
| LT0.W148C | 148 | 864 |
| LT0.K149C | 149 | 865 |
| LT0.A150C | 150 | 866 |
| LT0.D151C | 151 | 867 |
| LT0.S152C | 152 | 868 |
| LT0.S153C | 153 | 869 |
| LT0.P154C | 154 | 870 |
| LT0.V155C | 155 | 871 |

TABLE 37-continued

| Variant of G7-IgG1 light chain constant region | Position of cysteine substitution (Rabat numbering) | SEQ ID NO: |
|---|---|---|
| LT0.K156C | 156 | 872 |
| LT0.A157C | 157 | 873 |
| LT0.G158C | 158 | 874 |
| LT0.V159C | 159 | 875 |
| LT0.E160C | 160 | 876 |
| LT0.T161C | 161 | 877 |
| LT0.T162C | 162 | 878 |
| LT0.T163C | 163 | 879 |
| LT0.P164C | 164 | 880 |
| LT0.S165C | 165 | 881 |
| LT0.K166C | 166 | 882 |
| LT0.Q167C | 167 | 883 |
| LT0.S168C | 168 | 884 |
| LT0.N170C | 170 | 885 |
| LT0.N171C | 171 | 886 |
| LT0.K172C | 172 | 887 |
| LT0.Y173C | 173 | 888 |
| LT0.A174C | 174 | 889 |
| LT0.A175C | 175 | 890 |
| LT0.S180C | 180 | 891 |
| LT0.L181C | 181 | 892 |
| LT0.T182C | 182 | 893 |
| LT0.P183C | 183 | 894 |
| LT0.E184C | 184 | 895 |
| LT0.Q185C | 185 | 896 |
| LT0.W186C | 186 | 897 |
| LT0.K187C | 187 | 898 |
| LT0.S188C | 188 | 899 |
| LT0.H189C | 189 | 900 |
| LT0.R190C | 190 | 901 |
| LT0.S191C | 191 | 902 |
| LT0.Y192C | 192 | 903 |
| LT0.S193C | 193 | 904 |
| LT0.Q195C | 195 | 905 |
| LT0.V196C | 196 | 906 |
| LT0.T197C | 197 | 907 |
| LT0.H198C | 198 | 908 |
| LT0.E199C | 199 | 909 |
| LT0.G200C | 200 | 910 |
| LT0.S203C | 203 | 911 |
| LT0.T204C | 204 | 912 |
| LT0.V205C | 205 | 913 |
| LT0.E206C | 206 | 914 |
| LT0.K207C | 207 | 915 |
| LT0.T208C | 208 | 916 |
| LT0.V209C | 209 | 917 |
| LT0.A210C | 210 | 918 |
| LT0.P211C | 211 | 919 |
| LT0.T212C | 212 | 920 |
| LT0.E213C | 213 | 921 |

The G7-IgG1 light chain variants produced above were combined with the G7-IgG1 heavy chain and the resultant G7-IgG1 light chain variants shown in Table 38 were expressed by transient expression using FreeStyle293 cells (Invitrogen) or Expi293 cells (Life technologies) by a method known to the person skilled in the art, and purified with Protein A by a method known to the person skilled in the art.

TABLE 38

| G7-IgG1 light chain variant name | Heavy chain variable region SEQ ID NO: | Heavy chain constant region SEQ ID NO: | Light chain variable region SEQ ID NO: | Light chain constant region SEQ ID NO: |
|---|---|---|---|---|
| G7L.T5C-IgG1 | 315 | 18 | 771 | 318 |
| G7L.Q6C-IgG1 | 315 | 18 | 772 | 318 |
| G7L.P7C-IgG1 | 315 | 18 | 773 | 318 |
| G7L.P8C-IgG1 | 315 | 18 | 774 | 318 |

TABLE 38-continued

| G7-IgG1 light chain variant name | Heavy chain variable region SEQ ID NO: | Heavy chain constant region SEQ ID NO: | Light chain variable region SEQ ID NO: | Light chain constant region SEQ ID NO: |
|---|---|---|---|---|
| G7L.S9C-IgG1 | 315 | 18 | 775 | 318 |
| G7L.A11C-IgG1 | 315 | 18 | 776 | 318 |
| G7L.S12C-IgG1 | 315 | 18 | 777 | 318 |
| G7L.G13C-IgG1 | 315 | 18 | 778 | 318 |
| G7L.T14C-IgG1 | 315 | 18 | 779 | 318 |
| G7L.P15C-IgG1 | 315 | 18 | 780 | 318 |
| G7L.G16C-IgG1 | 315 | 18 | 781 | 318 |
| G7L.Q17C-IgG1 | 315 | 18 | 782 | 318 |
| G7L.R18C-IgG1 | 315 | 18 | 783 | 318 |
| G7L.V19C-IgG1 | 315 | 18 | 784 | 318 |
| G7L.T20C-IgG1 | 315 | 18 | 785 | 318 |
| G7L.I21C-IgG1 | 315 | 18 | 786 | 318 |
| G7L.S22C-IgG1 | 315 | 18 | 787 | 318 |
| G7L.G25C-IgG1 | 315 | 18 | 788 | 318 |
| G7L.S26C-IgG1 | 315 | 18 | 789 | 318 |
| G7L.S27C-IgG1 | 315 | 18 | 790 | 318 |
| G7L.S27aC-IgG1 | 315 | 18 | 791 | 318 |
| G7L.T32C-IgG1 | 315 | 18 | 792 | 318 |
| G7L.V33C-IgG1 | 315 | 18 | 793 | 318 |
| G7L.N34C-IgG1 | 315 | 18 | 794 | 318 |
| G7L.N50C-IgG1 | 315 | 18 | 795 | 318 |
| G7L.N51C-IgG1 | 315 | 18 | 796 | 318 |
| G7L.P55C-IgG1 | 315 | 18 | 797 | 318 |
| G7L.S56C-IgG1 | 315 | 18 | 798 | 318 |
| G7L.G57C-IgG1 | 315 | 18 | 799 | 318 |
| G7L.I58C-IgG1 | 315 | 18 | 800 | 318 |
| G7L.P59C-IgG1 | 315 | 18 | 801 | 318 |
| G7L.D60C-IgG1 | 315 | 18 | 802 | 318 |
| G7L.R61C-IgG1 | 315 | 18 | 803 | 318 |
| G7L.F62C-IgG1 | 315 | 18 | 804 | 318 |
| G7L.S63C-IgG1 | 315 | 18 | 805 | 318 |
| G7L.S65C-IgG1 | 315 | 18 | 806 | 318 |
| G7L.S67C-IgG1 | 315 | 18 | 807 | 318 |
| G7L.G68C-IgG1 | 315 | 18 | 808 | 318 |
| G7L.T69C-IgG1 | 315 | 18 | 809 | 318 |
| G7L.S70C-IgG1 | 315 | 18 | 810 | 318 |
| G7L.S72C-IgG1 | 315 | 18 | 811 | 318 |
| G7L.L73C-IgG1 | 315 | 18 | 812 | 318 |
| G7L.V74C-IgG1 | 315 | 18 | 813 | 318 |
| G7L.I75C-IgG1 | 315 | 18 | 814 | 318 |
| G7L.S76C-IgG1 | 315 | 18 | 815 | 318 |
| G7L.G77C-IgG1 | 315 | 18 | 816 | 318 |
| G7L.L78C-IgG1 | 315 | 18 | 817 | 318 |
| G7L.Q79C-IgG1 | 315 | 18 | 818 | 318 |
| G7L.R96C-IgG1 | 315 | 18 | 819 | 318 |
| G7L.V97C-IgG1 | 315 | 18 | 820 | 318 |
| G7L.F98C-IgG1 | 315 | 18 | 821 | 318 |
| G7L.G99C-IgG1 | 315 | 18 | 822 | 318 |
| G7L.G100C-IgG1 | 315 | 18 | 823 | 318 |
| G7L.G101C-IgG1 | 315 | 18 | 824 | 318 |
| G7L.T102C-IgG1 | 315 | 18 | 825 | 318 |
| G7L.K103C-IgG1 | 315 | 18 | 826 | 318 |
| G7L.L104C-IgG1 | 315 | 18 | 827 | 318 |
| G7L.T105C-IgG1 | 315 | 18 | 828 | 318 |
| G7L.V106C-IgG1 | 315 | 18 | 829 | 318 |
| G7L.L106aC-IgG1 | 315 | 18 | 830 | 318 |
| LT0.Q108C-IgG1 | 315 | 18 | 317 | 831 |
| LT0.P109C-IgG1 | 315 | 18 | 317 | 832 |
| LT0.K110C-IgG1 | 315 | 18 | 317 | 833 |
| LT0.A111C-IgG1 | 315 | 18 | 317 | 834 |
| LT0.A112C-IgG1 | 315 | 18 | 317 | 835 |
| LT0.P113C-IgG1 | 315 | 18 | 317 | 836 |
| LT0.S114C-IgG1 | 315 | 18 | 317 | 837 |
| LT0.V115C-IgG1 | 315 | 18 | 317 | 838 |
| LT0.T116C-IgG1 | 315 | 18 | 317 | 839 |
| LT0.P120C-IgG1 | 315 | 18 | 317 | 840 |
| LT0.S121C-IgG1 | 315 | 18 | 317 | 841 |
| LT0.S122C-IgG1 | 315 | 18 | 317 | 842 |
| LT0.E123C-IgG1 | 315 | 18 | 317 | 843 |
| LT0.E124C-IgG1 | 315 | 18 | 317 | 844 |
| LT0.L125C-IgG1 | 315 | 18 | 317 | 845 |
| LT0.Q126C-IgG1 | 315 | 18 | 317 | 846 |
| LT0.A127C-IgG1 | 315 | 18 | 317 | 847 |
| LT0.N128C-IgG1 | 315 | 18 | 317 | 848 |
| LT0.K129C-IgG1 | 315 | 18 | 317 | 849 |
| LT0.A130C-IgG1 | 315 | 18 | 317 | 850 |
| LT0.T131C-IgG1 | 315 | 18 | 317 | 851 |
| LT0.I136C-IgG1 | 315 | 18 | 317 | 852 |
| LT0.S137C-IgG1 | 315 | 18 | 317 | 853 |
| LT0.D138C-IgG1 | 315 | 18 | 317 | 854 |
| LT0.F139C-IgG1 | 315 | 18 | 317 | 855 |
| LT0.Y140C-IgG1 | 315 | 18 | 317 | 856 |
| LT0.P141C-IgG1 | 315 | 18 | 317 | 857 |
| LT0.G142C-IgG1 | 315 | 18 | 317 | 858 |
| LT0.A143C-IgG1 | 315 | 18 | 317 | 859 |
| LT0.V144C-IgG1 | 315 | 18 | 317 | 860 |
| LT0.T145C-IgG1 | 315 | 18 | 317 | 861 |
| LT0.V146C-IgG1 | 315 | 18 | 317 | 862 |
| LT0.A147C-IgG1 | 315 | 18 | 317 | 863 |
| LT0.W148C-IgG1 | 315 | 18 | 317 | 864 |
| LT0.K149C-IgG1 | 315 | 18 | 317 | 865 |
| LT0.A150C-IgG1 | 315 | 18 | 317 | 866 |
| LT0.D151C-IgG1 | 315 | 18 | 317 | 867 |
| LT0.S152C-IgG1 | 315 | 18 | 317 | 868 |
| LT0.S153C-IgG1 | 315 | 18 | 317 | 869 |
| LT0.P154C-IgG1 | 315 | 18 | 317 | 870 |
| LT0.V155C-IgG1 | 315 | 18 | 317 | 871 |
| LT0.K156C-IgG1 | 315 | 18 | 317 | 872 |
| LT0.A157C-IgG1 | 315 | 18 | 317 | 873 |
| LT0.G158C-IgG1 | 315 | 18 | 317 | 874 |
| LT0.V159C-IgG1 | 315 | 18 | 317 | 875 |
| LT0.E160C-IgG1 | 315 | 18 | 317 | 876 |
| LT0.T161C-IgG1 | 315 | 18 | 317 | 877 |
| LT0.T162C-IgG1 | 315 | 18 | 317 | 878 |
| LT0.T163C-IgG1 | 315 | 18 | 317 | 879 |
| LT0.P164C-IgG1 | 315 | 18 | 317 | 880 |
| LT0.S165C-IgG1 | 315 | 18 | 317 | 881 |
| LT0.K166C-IgG1 | 315 | 18 | 317 | 882 |
| LT0.Q167C-IgG1 | 315 | 18 | 317 | 883 |
| LT0.S168C-IgG1 | 315 | 18 | 317 | 884 |
| LT0.N170C-IgG1 | 315 | 18 | 317 | 885 |
| LT0.N171C-IgG1 | 315 | 18 | 317 | 886 |
| LT0.K172C-IgG1 | 315 | 18 | 317 | 887 |
| LT0.Y173C-IgG1 | 315 | 18 | 317 | 888 |
| LT0.A174C-IgG1 | 315 | 18 | 317 | 889 |
| LT0.A175C-IgG1 | 315 | 18 | 317 | 890 |
| LT0.S180C-IgG1 | 315 | 18 | 317 | 891 |
| LT0.L181C-IgG1 | 315 | 18 | 317 | 892 |
| LT0.T182C-IgG1 | 315 | 18 | 317 | 893 |
| LT0.P183C-IgG1 | 315 | 18 | 317 | 894 |
| LT0.E184C-IgG1 | 315 | 18 | 317 | 895 |
| LT0.Q185C-IgG1 | 315 | 18 | 317 | 896 |
| LT0.W186C-IgG1 | 315 | 18 | 317 | 897 |
| LT0.K187C-IgG1 | 315 | 18 | 317 | 898 |
| LT0.S188C-IgG1 | 315 | 18 | 317 | 899 |
| LT0.H189C-IgG1 | 315 | 18 | 317 | 900 |
| LT0.R190C-IgG1 | 315 | 18 | 317 | 901 |
| LT0.S191C-IgG1 | 315 | 18 | 317 | 902 |
| LT0.Y192C-IgG1 | 315 | 18 | 317 | 903 |
| LT0.S193C-IgG1 | 315 | 18 | 317 | 904 |
| LT0.Q195C-IgG1 | 315 | 18 | 317 | 905 |
| LT0.V196C-IgG1 | 315 | 18 | 317 | 906 |
| LT0.T197C-IgG1 | 315 | 18 | 317 | 907 |
| LT0.H198C-IgG1 | 315 | 18 | 317 | 908 |
| LT0.E199C-IgG1 | 315 | 18 | 317 | 909 |
| LT0.G200C-IgG1 | 315 | 18 | 317 | 910 |
| LT0.S203C-IgG1 | 315 | 18 | 317 | 911 |
| LT0.T204C-IgG1 | 315 | 18 | 317 | 912 |
| LT0.V205C-IgG1 | 315 | 18 | 317 | 913 |
| LT0.E206C-IgG1 | 315 | 18 | 317 | 914 |
| LT0.K207C-IgG1 | 315 | 18 | 317 | 915 |
| LT0.T208C-IgG1 | 315 | 18 | 317 | 916 |
| LT0.V209C-IgG1 | 315 | 18 | 317 | 917 |
| LT0.A210C-IgG1 | 315 | 18 | 317 | 918 |

TABLE 38-continued

| G7-IgG1 light chain variant name | Heavy chain variable region SEQ ID NO: | Heavy chain constant region SEQ ID NO: | Light chain variable region SEQ ID NO: | Light chain constant region SEQ ID NO: |
|---|---|---|---|---|
| LT0.P211C-IgG1 | 315 | 18 | 317 | 919 |
| LT0.T212C-IgG1 | 315 | 18 | 317 | 920 |
| LT0.E213C-IgG1 | 315 | 18 | 317 | 921 |

Example 11-2 Assessment of Electrophoretic Mobility in Pglyacrylamide Gel of Antibodies Having Cysteine Substitution at Various Positions of the Lambda Chain Similarly to Example 8-2, non-reducing SDS-PAGE was carried out with the G7-IgG1 variants produced in Example 11-1, the gel image was captured, and bands were quantified. From the obtained gel image, the variants were classified into 7 groups according to the band pattern of each of the G7-IgG1 variants: Single (one band at a molecular weight region similar to that of G7-IgG1), Double (two bands at a molecular weight region similar to that of G7-IgG1), Triple (three bands at a molecular weight region similar to that of G7-IgG1), Several (four or more bands at a molecular weight region similar to that of G7-IgG1), LMW (band(s) at a molecular weight region lower than that of G7-IgG1), HMW (band(s) at a molecular weight region higher than that of G7-IgG1), and Faint (band(s) blurry and difficult to determine). Regarding the G7-IgG1 variants classified as "Double", one of the two bands showed the same electrophoretic mobility as G7-IgG1 while the other band showed slightly faster or slower mobility. Thus, for the G7-IgG1 variants classified as "Double", the percentage of the bands showing different mobility to G7-IgG1 (percentage of new band (%)) was also calculated. Grouping of the band patterns for G7-IgG1 light chain variants and the calculation results of the band percentage are shown in Table 39. From Table 39, variants classified into the Double and Triple groups are shown in Table 40. In these variants, it is highly likely that cysteine substitution caused structural changes such as crosslinkage of Fabs, which resulted in the change in electrophoretic mobility. In this Example, the variant in which the amino acid residue at position 107a (Kabat numbering) was substituted with cysteine was not assessed. However, position 107a (Kabat numbering) is a position where the residue structurally exposed to the surface is present in the hinge region. Thus, in this variant also, it is highly likely that cysteine substitution causes structural changes such as crosslinkage of Fabs, and results in the change in electrophoretic mobility.

TABLE 39

| G7-IgG1 light chain variant name | Group | Percentage of new band (%) |
|---|---|---|
| G7L.T5C-IgG1 | Single | — |
| G7L.Q6C-IgG1 | Triple | — |
| G7L.P7C-IgG1 | Single | — |
| G7L.P8C-IgG1 | Single | — |
| G7L.S9C-IgG1 | Single | — |
| G7L.A11C-IgG1 | Single | — |
| G7L.S12C-IgG1 | Single | — |
| G7L.G13C-IgG1 | Single | — |
| G7L.T14C-IgG1 | Single | — |
| G7L.P15C-IgG1 | Single | — |
| G7L.G16C-IgG1 | Faint | — |
| G7L.Q17C-IgG1 | Single | — |
| G7L.R18C-IgG1 | Single | — |
| G7L.V19C-IgG1 | Double | 32.3 |
| G7L.T20C-IgG1 | Single | — |
| G7L.I21C-IgG1 | Faint | — |
| G7L.S22C-IgG1 | Single | — |
| G7L.G25C-IgG1 | Single | — |
| G7L.S26C-IgG1 | Single | — |
| G7L.S27C-IgG1 | Single | — |
| G7L.S27aC-IgG1 | Single | — |
| G7L.T32C-IgG1 | Single | — |
| G7L.V33C-IgG1 | Triple | — |
| G7L.N34C-IgG1 | Double | 43.8 |
| G7L.N50C-IgG1 | Single | — |
| G7L.N51C-IgG1 | Single | — |
| G7L.P55C-IgG1 | Single | — |
| G7L.S56C-IgG1 | Single | — |
| G7L.G57C-IgG1 | Single | — |
| G7L.I58C-IgG1 | Single | — |
| G7L.P59C-IgG1 | Single | — |
| G7L.D60C-IgG1 | Single | — |
| G7L.R61C-IgG1 | Single | — |
| G7L.F62C-IgG1 | Faint | — |
| G7L.S63C-IgG1 | Single | — |
| G7L.S65C-IgG1 | Single | — |
| G7L.S67C-IgG1 | Single | — |
| G7L.G68C-IgG1 | Single | — |
| G7L.T69C-IgG1 | Single | — |
| G7L.S70C-IgG1 | Single | — |
| G7L.S72C-IgG1 | Single | — |
| G7L.L73C-IgG1 | Faint | — |
| G7L.V74C-IgG1 | Single | — |
| G7L.I75C-IgG1 | Faint | — |
| G7L.S76C-IgG1 | Single | — |
| G7L.G77C-IgG1 | Single | — |
| G7L.L78C-IgG1 | Faint | — |
| G7L.Q79C-IgG1 | Single | — |
| G7L.R96C-IgG1 | Single | — |
| G7L.V97C-IgG1 | Faint | — |
| G7L.F98C-IgG1 | Single | — |
| G7L.G99C-IgG1 | Faint | — |
| G7L.G100C-IgG1 | Single | — |
| G7L.G101C-IgG1 | Single | — |
| G7L.T102C-IgG1 | Faint | — |
| G7L.K103C-IgG1 | Single | — |
| G7L.L104C-IgG1 | Faint | — |
| G7L.T105C-IgG1 | Single | — |
| G7L.V106C-IgG1 | Faint | — |
| G7L.L106aC-IgG1 | Single | — |
| LT0.Q108C-IgG1 | Double | 10.6 |
| LT0.P109C-IgG1 | Double | 42.9 |
| LT0.K110C-IgG1 | Single | — |
| LT0.A111C-IgG1 | Single | — |
| LT0.A112C-IgG1 | Single | — |
| LT0.P113C-IgG1 | LMW | — |
| LT0.S114C-IgG1 | Single | — |
| LT0.V115C-IgG1 | LMW | — |
| LT0.T116C-IgG1 | Single | — |
| LT0.P120C-IgG1 | LMW | — |
| LT0.S121C-IgG1 | LMW | — |
| LT0.S122C-IgG1 | no data | — |
| LT0.E123C-IgG1 | Double | 57.5 |
| LT0.E124C-IgG1 | LMW | — |
| LT0.L125C-IgG1 | LMW | — |
| LT0.Q126C-IgG1 | Triple | — |
| LT0.A127C-IgG1 | Single | — |
| LT0.N128C-IgG1 | Single | — |
| LT0.K129C-IgG1 | Single | — |
| LT0.A130C-IgG1 | LMW | — |
| LT0.T131C-IgG1 | LMW | — |
| LT0.I136C-IgG1 | LMW | — |
| LT0.S137C-IgG1 | Single | — |
| LT0.D138C-IgG1 | Single | — |
| LT0.F139C-IgG1 | LMW | — |
| LT0.Y140C-IgG1 | Single | — |

TABLE 39-continued

| G7-IgG1 light chain variant name | Group | Percentage of new band (%) |
|---|---|---|
| LT0.P141C-IgG1 | Single | — |
| LT0.G142C-IgG1 | Single | — |
| LT0.A143C-IgG1 | Single | — |
| LT0.V144C-IgG1 | LMW | — |
| LT0.T145C-IgG1 | Single | — |
| LT0.V146C-IgG1 | LMW | — |
| LT0.A147C-IgG1 | Single | — |
| LT0.W148C-IgG1 | no data | — |
| LT0.K149C-IgG1 | Single | — |
| LT0.A150C-IgG1 | Single | — |
| LT0.D151C-IgG1 | Single | — |
| LT0.S152C-IgG1 | Single | — |
| LT0.S153C-IgG1 | Single | — |
| LT0.P154C-IgG1 | Single | — |
| LT0.V155C-IgG1 | Single | — |
| LT0.K156C-IgG1 | Single | — |
| LT0.A157C-IgG1 | Single | — |
| LT0.G158C-IgG1 | no data | — |
| LT0.V159C-IgG1 | Single | — |
| LT0.E160C-IgG1 | Single | — |
| LT0.T161C-IgG1 | Single | — |
| LT0.T162C-IgG1 | Single | — |
| LT0.T163C-IgG1 | Single | — |
| LT0.P164C-IgG1 | Single | — |
| LT0.S165C-IgG1 | Single | — |
| LT0.K166C-IgG1 | Single | — |
| LT0.Q167C-IgG1 | Single | — |
| LT0.S168C-IgG1 | Single | — |
| LT0.N170C-IgG1 | Single | — |
| LT0.N171C-IgG1 | Single | — |
| LT0.K172C-IgG1 | Single | — |
| LT0.Y173C-IgG1 | Single | — |
| LT0.A174C-IgG1 | LMW | — |
| LT0.A175C-IgG1 | LMW | — |
| LT0.S180C-IgG1 | Single | — |
| LT0.L181C-IgG1 | Single | — |
| LT0.T182C-IgG1 | Single | — |
| LT0.P183C-IgG1 | LMW | — |
| LT0.E184C-IgG1 | Single | — |
| LT0.Q185C-IgG1 | Single | — |
| LT0.W186C-IgG1 | LMW | — |
| LT0.K187C-IgG1 | LMW | — |
| LT0.S188C-IgG1 | LMW | — |
| LT0.H189C-IgG1 | LMW | — |
| LT0.R190C-IgG1 | LMW | — |
| LT0.S191C-IgG1 | Single | — |
| LT0.Y192C-IgG1 | Single | — |
| LT0.S193C-IgG1 | Single | — |
| LT0.Q195C-IgG1 | Double | 30.1 |
| LT0.V196C-IgG1 | Double | 82.9 |
| LT0.T197C-IgG1 | Single | — |
| LT0.H198C-IgG1 | Faint | — |
| LT0.E199C-IgG1 | Single | — |
| LT0.G200C-IgG1 | Double | 15.5 |
| LT0.S203C-IgG1 | Double | 32.4 |
| LT0.T204C-IgG1 | Single | — |
| LT0.V205C-IgG1 | Single | — |
| LT0.E206C-IgG1 | Single | — |
| LT0.K207C-IgG1 | Single | — |
| LT0.T208C-IgG1 | Single | — |
| LT0.V209C-IgG1 | LMW | — |
| LT0.A210C-IgG1 | LMW | — |
| LT0.P211C-IgG1 | Faint | — |
| LT0.T212C-IgG1 | LMW | — |
| LT0.E213C-IgG1 | Single | — |

TABLE 40

| G7-IgG1 light chain variant name | Group | Percentage of new band (%) |
|---|---|---|
| G7L.Q6C-IgG1 | Triple | — |
| G7L.V19C-IgG1 | Double | 32.3 |
| G7L.V33C-IgG1 | Triple | — |

TABLE 40-continued

| G7-IgG1 light chain variant name | Group | Percentage of new band (%) |
|---|---|---|
| G7L.N34C-IgG1 | Double | 43.8 |
| LT0.Q108C-IgG1 | Double | 10.6 |
| LT0.P109C-IgG1 | Double | 42.9 |
| LT0.E123C-IgG1 | Double | 57.5 |
| LT0.Q126C-IgG1 | Triple | — |
| LT0.Q195C-IgG1 | Double | 30.1 |
| LT0.V196C-IgG1 | Double | 82.9 |
| LT0.G200C-IgG1 | Double | 15.5 |
| LT0.S203C-IgG1 | Double | 32.4 |

Example 12 Assessment of Antibodies Having Cysteine Substitution at Various Positions of VHH Example 12-1 Production of Antibodies Having Cysteine Substitution at Various Positions of VHH An anti-human IL6R neutralizing VHH, L6R90 (SEQ ID NO: 319) was fused with a human IgG1 Fc region (G123dCH1dC, SEQ ID NO: 320) to produce L6R90-Fc (IL6R90-G1T3dCH1dC, SEQ ID NO: 321), and this was subjected to a study in whiich an arbitrary amino acid residue among the L6R90 region structurally exposed to the surface was substituted with cysteine.

Amino acid residues within the L6R90 region were substituted with cysteine, and expression vectors encoding the genes of 5L6R90-FcVHH region variants shown in Table 41 were produced by a method known to the person skilled in the art. These variants of the L6R90-Fc VHH region were each linked with the Fc region of human IgG1 (G1T3dCH1dC, SEQ ID NO: 320) to produce IL6R90-Fc variants, and expression vectors encoding the corresponding genes were produced by a method known to the person skilled in the art.

TABLE 41

| Variant of IL6R90-Fc VHH region | Position of cysteine substitution (Kabat numbering) | SEQ ID NO: |
|---|---|---|
| IL6R90.E1C | 1 | 922 |
| IL6R90.V2C | 2 | 923 |
| IL6R90.Q3C | 3 | 924 |
| IL6R90.L4C | 4 | 925 |
| IL6R90.V5C | 5 | 926 |
| IL6R90.E6C | 6 | 927 |
| IL6R90.S7C | 7 | 928 |
| IL6R90.G8C | 8 | 929 |
| IL6R90.G9C | 9 | 930 |
| IL6R90.G10C | 10 | 931 |
| IL6R90.L11C | 11 | 932 |
| IL6R90.V12C | 12 | 933 |
| IL6R90.Q13C | 13 | 934 |
| IL6R90.P14C | 14 | 935 |
| IL6R90.G15C | 15 | 936 |
| IL6R90.G16C | 16 | 937 |
| IL6R90.S17C | 17 | 938 |
| IL6R90.L18C | 18 | 939 |
| IL6R90.R19C | 19 | 940 |
| IL6R90.L20C | 20 | 941 |
| IL6R90.S21C | 21 | 942 |
| IL6R90.A23C | 23 | 943 |
| IL6R90.A24C | 24 | 944 |
| IL6R90.S25C | 25 | 945 |
| IL6R90.G26C | 26 | 946 |
| IL6R90.F27C | 27 | 947 |
| IL6R90.T28C | 28 | 948 |
| IL6R90.F29C | 29 | 949 |
| IL6R90.D30C | 30 | 950 |

TABLE 41-continued

| Variant of IL6R90-Fc VHH region | Position of cysteine substitution (Kabat numbering) | SEQ ID NO: |
|---|---|---|
| IL6R90.W36C | 36 | 951 |
| IL6R90.V37C | 37 | 952 |
| IL6R90.R38C | 38 | 953 |
| IL6R90.Q39C | 39 | 954 |
| IL6R90.A40C | 40 | 955 |
| IL6R90.P41C | 41 | 956 |
| IL6R90.G42C | 42 | 957 |
| IL6R90.K43C | 43 | 958 |
| IL6R90.A44C | 44 | 959 |
| IL6R90.L45C | 45 | 960 |
| IL6R90.E46C | 46 | 961 |
| IL6R90.W47C | 47 | 962 |
| IL6R90.V48C | 48 | 963 |
| IL6R90.S49C | 49 | 964 |
| IL6R90.R66C | 66 | 965 |
| IL6R90.F67C | 67 | 966 |
| IL6R90.T68C | 68 | 967 |
| IL6R90.I69C | 69 | 968 |
| IL6R90.S70C | 70 | 969 |
| IL6R90.R71C | 71 | 970 |
| IL6R90.D72C | 72 | 971 |
| IL6R90.N73C | 73 | 972 |
| IL6R90.A74C | 74 | 973 |
| IL6R90.K75C | 75 | 974 |
| IL6R90.N76C | 76 | 975 |
| IL6R90.T77C | 77 | 976 |
| IL6R90.L78C | 78 | 977 |
| IL6R90.Y79C | 79 | 978 |
| IL6R90.L80C | 80 | 979 |
| IL6R90.Q81C | 81 | 980 |
| IL6R90.M82C | 82 | 981 |
| IL6R90.N82aC | 82a | 982 |
| IL6R90.S82bC | 82b | 983 |
| IL6R90.L82cC | 82c | 984 |
| IL6R90.R83C | 83 | 985 |
| IL6R90.P84C | 84 | 986 |
| IL6R90.E85C | 85 | 987 |
| IL6R90.D86C | 86 | 988 |
| IL6R90.T87C | 87 | 989 |
| IL6R90.A88C | 88 | 990 |
| IL6R90.V89C | 89 | 991 |
| IL6R90.Y90C | 90 | 992 |
| IL6R90.Y91C | 91 | 993 |
| IL6R90.V93C | 93 | 994 |
| IL6R90.K94C | 94 | 995 |
| IL6R90.W103C | 103 | 996 |
| IL6R90.G104C | 104 | 997 |
| IL6R90.Q105C | 105 | 998 |
| IL6R90.G106C | 106 | 999 |
| IL6R90.T107C | 107 | 1000 |
| IL6R90.L108C | 108 | 1001 |
| IL6R90.V109C | 109 | 1002 |
| IL6R90.T110C | 110 | 1003 |
| IL6R90.V111C | 111 | 1004 |
| IL6R90.S112C | 112 | 1005 |
| IL6R90.S113C | 113 | 1006 |

IL6R90-Fc variants produced above and shown in Table 42 were expressed by transient expression using FreeStyle293 cells (Invitrogen) or Expi293 cells (Life technologies) by a method known to the person skilled in the art, and purified with Protein A by a method known to the person skilled in the art.

TABLE 42

| IL6R90-Fc variant name | VHH region SEQ ID NO: | Fc region SEQ ID NO: |
|---|---|---|
| IL6R90.E1C-Fc | 922 | 320 |
| IL6R90.V2C-Fc | 923 | 320 |
| IL6R90.Q3C-Fc | 924 | 320 |
| IL6R90.L4C-Fc | 925 | 320 |
| IL6R90.V5C-Fc | 926 | 320 |
| IL6R90.E6C-Fc | 927 | 320 |
| IL6R90.S7C-Fc | 928 | 320 |
| IL6R90.G8C-Fc | 929 | 320 |
| IL6R90.G9C-Fc | 930 | 320 |
| IL6R90.G10C-Fc | 931 | 320 |
| IL6R90.L11C-Fc | 932 | 320 |
| IL6R90.V12C-Fc | 933 | 320 |
| IL6R90.Q13C-Fc | 934 | 320 |
| IL6R90.P14C-Fc | 935 | 320 |
| IL6R90.G15C-Fc | 936 | 320 |
| IL6R90.G16C-Fc | 937 | 320 |
| IL6R90.S17C-Fc | 938 | 320 |
| IL6R90.L18C-Fc | 939 | 320 |
| IL6R90.R19C-Fc | 940 | 320 |
| IL6R90.L20C-Fc | 941 | 320 |
| IL6R90.S21C-Fc | 942 | 320 |
| IL6R90.A23C-Fc | 943 | 320 |
| IL6R90.A24C-Fc | 944 | 320 |
| IL6R90.S25C-Fc | 945 | 320 |
| IL6R90.G26C-Fc | 946 | 320 |
| IL6R90.F27C-Fc | 947 | 320 |
| IL6R90.T28C-Fc | 948 | 320 |
| IL6R90.F29C-Fc | 949 | 320 |
| IL6R90.D30C-Fc | 950 | 320 |
| IL6R90.W36C-Fc | 951 | 320 |
| IL6R90.V37C-Fc | 952 | 320 |
| IL6R90.R38C-Fc | 953 | 320 |
| IL6R90.Q39C-Fc | 954 | 320 |
| IL6R90.A40C-Fc | 955 | 320 |
| IL6R90.P41C-Fc | 956 | 320 |
| IL6R90.G42C-Fc | 957 | 320 |
| IL6R90.K43C-Fc | 958 | 320 |
| IL6R90.A44C-Fc | 959 | 320 |
| IL6R90.L45C-Fc | 960 | 320 |
| IL6R90.E46C-Fc | 961 | 320 |
| IL6R90.W47C-Fc | 962 | 320 |
| IL6R90.V48C-Fc | 963 | 320 |
| IL6R90.S49C-Fc | 964 | 320 |
| IL6R90.R66C-Fc | 965 | 320 |
| IL6R90.F67C-Fc | 966 | 320 |
| IL6R90.T68C-Fc | 967 | 320 |
| IL6R90.I69C-Fc | 968 | 320 |
| IL6R90.S70C-Fc | 969 | 320 |
| IL6R90.R71C-Fc | 970 | 320 |
| IL6R90.D72C-Fc | 971 | 320 |
| IL6R90.N73C-Fc | 972 | 320 |
| IL6R90.A74C-Fc | 973 | 320 |
| IL6R90.K75C-Fc | 974 | 320 |
| IL6R90.N76C-Fc | 975 | 320 |
| IL6R90.T77C-Fc | 976 | 320 |
| IL6R90.L78C-Fc | 977 | 320 |
| IL6R90.Y79C-Fc | 978 | 320 |
| IL6R90.L80C-Fc | 979 | 320 |
| IL6R90.Q81C-Fc | 980 | 320 |
| IL6R90.M82C-Fc | 981 | 320 |
| IL6R90.N82aC-Fc | 982 | 320 |
| IL6R90.S82bC-Fc | 983 | 320 |
| IL6R90.L82cC-Fc | 984 | 320 |
| IL6R90.R83C-Fc | 985 | 320 |
| IL6R90.P84C-Fc | 986 | 320 |
| IL6R90.E85C-Fc | 987 | 320 |
| IL6R90.D86C-Fc | 988 | 320 |
| IL6R90.T87C-Fc | 989 | 320 |
| IL6R90.A88C-Fc | 990 | 320 |
| IL6R90.V89C-Fc | 991 | 320 |
| IL6R90.Y90C-Fc | 992 | 320 |
| IL6R90.Y91C-Fc | 993 | 320 |
| IL6R90.V93C-Fc | 994 | 320 |
| IL6R90.K94C-Fc | 995 | 320 |
| IL6R90.W103C-Fc | 996 | 320 |
| IL6R90.G104C-Fc | 997 | 320 |
| IL6R90.Q105C-Fc | 998 | 320 |
| IL6R90.G106C-Fc | 999 | 320 |
| IL6R90.T107C-Fc | 1000 | 320 |
| IL6R90.L108C-Fc | 1001 | 320 |
| IL6R90.V109C-Fc | 1002 | 320 |

TABLE 42-continued

| IL6R90-Fc variant name | VHH region SEQ ID NO: | Fc region SEQ ID NO: |
|---|---|---|
| IL6R90.T110C-Fc | 1003 | 320 |
| IL6R90.V111C-Fc | 1004 | 320 |
| IL6R90.S112C-Fc | 1005 | 320 |
| IL6R90.S113C-Fc | 1006 | 320 |

Example 12-2 Assessment of Electrophoretic Mobility in Pglyacrylamide Gel of Antibodies Having Cysteine Substitution at Various Positions of VHH It was examined with non-reducing SDS-PAGE whether the IL6R90-Fc variants produced in Example 12-1 show a different electrophoretic mobility to IL6R90-Fc. Sample Buffer Solution (2ME-) (×4) (Wako; 198-13282) was used for preparing electrophoresis samples, the samples were treated for 10 minutes under the condition of specimen concentration 50 μg/mL and 70° C., and then subjected to non-reducing SDS-PAGE. Mini-PROTEAN TGX Precast gel 4-20% 15 well (BIORAD; 456-1096) was used for non-reducing SDS-PAGE and electrophoresis was carried out at 200 V for 2.5 hours. Then, the gel was stained with CBB stain, the gel image was captured with ChemiDoc-TouchMP (BIORAD), and the bands were quantified with Image Lab (BIORAD).

From the obtained gel image, the variants were classified into 7 groups according to the band pattern of each of the IL6R90-Fc variants: Single (one band at a molecular weight region similar to that of IL6R90-Fc), Double (two bands at a molecular weight region similar to that of IL6R90-Fc), Triple (three bands at a molecular weight region similar to that of IL6R90-Fc), Several (four or more bands at a molecular weight region similar to that of IL6R90-Fc), LMW (band(s) at a molecular weight region lower than that of IL6R90-Fc), HMW (band(s) at a molecular weight region higher than that of IL6R90-Fc), and Faint (band(s) blurry and difficult to determine). Regarding the IL6R90-Fc variants classified as "Double", one of the two bands showed the same electrophoretic mobility as IL6R90-Fc while the other band showed slightly faster or slower mobility. Thus, for the IL6R90-Fc variants classified as "Double", the percentage of the bands showing different electrophoretic mobility to IL6R90-Fc (percentage of new band (%)) was also calculated. Grouping of the band patterns for IL6R90-Fc variants and the calculation results of the band percentage are shown in Table 43. From Table 43, variants classified into the Double and Triple groups are shown in Table 44. In these variants, it is highly likely that cysteine substitution caused structural changes such as crosslinkage of VHHs, which resulted in the change in electrophoretic mobility.

TABLE 43

| IL6R90-Fc variant name | Group | Percentage of new band (%) |
|---|---|---|
| IL6R90.E1C-Fc | Single | — |
| IL6R90.V2C-Fc | Single | — |
| IL6R90.Q3C-Fc | Single | — |
| IL6R90.L4C-Fc | Triple | — |
| IL6R90.V5C-Fc | Single | — |
| IL6R90.E6C-Fc | Double | 65.2 |
| IL6R90.S7C-Fc | Double | 16.4 |
| IL6R90.G8C-Fc | Double | 38.4 |
| IL6R90.G9C-Fc | Double | 71.8 |
| IL6R90.G10C-Fc | Double | 9.7 |
| IL6R90.L11C-Fc | Double | 59.8 |
| IL6R90.V12C-Fc | Double | 24.8 |
| IL6R90.Q13C-Fc | no data | — |
| IL6R90.P14C-Fc | Double | 16.8 |
| IL6R90.G15C-Fc | Double | 18.6 |
| IL6R90.G16C-Fc | Single | — |
| IL6R90.S17C-Fc | Double | 16.6 |
| IL6R90.L18C-Fc | Single | — |
| IL6R90.R19C-Fc | Single | — |
| IL6R90.L20C-Fc | Double | 57.4 |
| IL6R90.S21C-Fc | Single | — |
| IL6R90.A23C-Fc | Single | — |
| IL6R90.A24C-Fc | Double | 59.3 |
| IL6R90.S25C-Fc | Single | — |
| IL6R90.G26C-Fc | Single | — |
| IL6R90.F27C-Fc | Double | 61.5 |
| IL6R90.T28C-Fc | Single | — |
| IL6R90.F29C-Fc | Double | 56.7 |
| IL6R90.D30C-Fc | Single | — |
| IL6R90.W36C-Fc | no data | — |
| IL6R90.V37C-Fc | Single | — |
| IL6R90.R38C-Fc | Double | 64.5 |
| IL6R90.Q39C-Fc | Double | 12.9 |
| IL6R90.A40C-Fc | Double | 3.2 |
| IL6R90.P41C-Fc | Double | 15.9 |
| IL6R90.G42C-Fc | HMW | — |
| IL6R90.K43C-Fc | Double | 9.2 |
| IL6R90.A44C-Fc | Double | 17.9 |
| IL6R90.L45C-Fc | Double | 15.4 |
| IL6R90.E46C-Fc | Double | 16.4 |
| IL6R90.W47C-Fc | Double | 12.6 |
| IL6R90.V48C-Fc | Double | 14.7 |
| IL6R90.S49C-Fc | Double | 54.1 |
| IL6R90.R66C-Fc | Single | — |
| IL6R90.F67C-Fc | Double | 34.8 |
| IL6R90.T68C-Fc | Single | — |
| IL6R90.I69C-Fc | Double | 57.5 |
| IL6R90.S70C-Fc | Single | — |
| IL6R90.R71C-Fc | Double | 34.3 |
| IL6R90.D72C-Fc | Single | — |
| IL6R90.N73C-Fc | Single | — |
| IL6R90.A74C-Fc | Single | — |
| IL6R90.K75C-Fc | Single | — |
| IL6R90.N76C-Fc | Single | — |
| IL6R90.T77C-Fc | Single | — |
| IL6R90.L78C-Fc | Double | 40.6 |
| IL6R90.Y79C-Fc | Single | — |
| IL6R90.L80C-Fc | Double | 54.7 |
| IL6R90.Q81C-Fc | Single | — |
| IL6R90.M82C-Fc | Double | 47.7 |
| IL6R90.N82aC-Fc | Single | — |
| IL6R90.S82bC-Fc | HMW | — |
| IL6R90.L82cC-Fc | Double | 73.2 |
| IL6R90.R83C-Fc | Single | — |
| IL6R90.P84C-Fc | Single | — |
| IL6R90.E85C-Fc | Double | 9.4 |
| IL6R90.D86C-Fc | no data | — |
| IL6R90.T87C-Fc | Single | — |
| IL6R90.A88C-Fc | Double | 66.5 |
| IL6R90.V89C-Fc | LMW | — |
| IL6R90.Y90C-Fc | no data | — |
| IL6R90.Y91C-Fc | Triple | — |
| IL6R90.V93C-Fc | Triple | — |
| IL6R90.K94C-Fc | Double | 37.7 |
| IL6R90.W103C-Fc | Single | — |
| IL6R90.G104C-Fc | no data | — |
| IL6R90.Q105C-Fc | Single | — |
| IL6R90.G106C-Fc | no data | — |
| IL6R90.T107C-Fc | Double | 53.6 |
| IL6R90.L108C-Fc | Single | — |
| IL6R90.V109C-Fc | Faint | — |
| IL6R90.T110C-Fc | Single | — |

TABLE 43-continued

| IL6R90-Fc variant name | Group | Percentage of new band (%) |
|---|---|---|
| IL6R90.V111C-Fc | Single | — |
| IL6R90.S112C-Fc | Single | — |
| IL6R90.S113C-Fc | Single | — |

TABLE 44

| IL6R90-Fc variant name | Group | Percentage of new band (%) |
|---|---|---|
| IL6R90.L4C-Fc | Triple | — |
| IL6R90.E6C-Fc | Double | 65.2 |
| IL6R90.S7C-Fc | Double | 16.4 |
| IL6R90.G8C-Fc | Double | 38.4 |
| IL6R90.G9C-Fc | Double | 71.8 |
| IL6R90.G10C-Fc | Double | 9.7 |
| IL6R90.L11C-Fc | Double | 59.8 |
| IL6R90.V12C-Fc | Double | 24.8 |
| IL6R90.P14C-Fc | Double | 16.8 |
| IL6R90.G15C-Fc | Double | 18.6 |
| IL6R90.S17C-Fc | Double | 16.6 |
| IL6R90.L20C-Fc | Double | 57.4 |
| IL6R90.A24C-Fc | Double | 59.3 |
| IL6R90.F27C-Fc | Double | 61.5 |
| IL6R90.F29C-Fc | Double | 56.7 |
| IL6R90.R38C-Fc | Double | 64.5 |
| IL6R90.Q39C-Fc | Double | 12.9 |
| IL6R90.A40C-Fc | Double | 3.2 |
| IL6R90.P41C-Fc | Double | 15.9 |
| IL6R90.K43C-Fc | Double | 9.2 |
| IL6R90.A44C-Fc | Double | 17.9 |
| IL6R90.L45C-Fc | Double | 15.4 |
| IL6R90.E46C-Fc | Double | 16.4 |
| IL6R90.W47C-Fc | Double | 12.6 |
| IL6R90.V48C-Fc | Double | 14.7 |
| IL6R90.S49C-Fc | Double | 54.1 |
| IL6R90.F67C-Fc | Double | 34.8 |
| IL6R90.I69C-Fc | Double | 57.5 |
| IL6R90.R71C-Fc | Double | 34.3 |
| IL6R90.L78C-Fc | Double | 40.6 |
| IL6R90.L80C-Fc | Double | 54.7 |
| IL6R90.M82C-Fc | Double | 47.7 |
| IL6R90.L82cC-Fc | Double | 73.2 |
| IL6R90.E85C-Fc | Double | 9.4 |
| IL6R90.A88C-Fc | Double | 66.5 |
| IL6R90.Y91C-Fc | Triple | — |
| IL6R90.V93C-Fc | Triple | — |
| IL6R90.K94C-Fc | Double | 37.7 |
| IL6R90.T107C-Fc | Double | 53.6 |

Example 13 Assessment of CD3 Agonist Activity of Antibodies Having Cysteine Substitution within the Fab Example 13-1 Production of Antibodies Having Cysteine Substitution at the Constant Region An anti-human CD3 agonist antibody, OKT3 (heavy chain: OKT3VH0000-G1T4 (SEQ ID NO: 1007), light chain: OKT3VL0000-KT0 (SEQ ID NO: 1008)), was subjected to a study in which an arbitrary amino acid residue structurally exposed to the surface was substituted with cysteine.

Amino acid residues within the OKT3 heavy chain constant region (G1T4, SEQ ID NO: 1009) were substituted with cysteine to produce variants of the OKT3 heavy chain constant region shown in Table 45. These variants of the OKT3 heavy chain constant region were each linked with the OKT3 heavy chain variable region (OKT3VH0000, SEQ ID NO: 1010) to produce OKT3 heavy chain variants, and expression vectors encoding the corresponding genes were produced by a method known to the person skilled in the art.

TABLE 45

| Variant of OKT3 heavy chain constant region | Position of cysteine substitution (EU numbering) | SEQ ID NO: |
|---|---|---|
| G1T4.T135C | 135 | 1017 |
| G1T4.S136C | 136 | 1018 |
| G1T4.S191C | 191 | 1019 |

Similarly, an amino acid residue within the OKT3 light chain constant region (KT0, SEQ ID NO: 1011) was substituted with cysteine to produce a variant of the OKT3 light chain constant region shown in Table 46. This variant of the OKT3 light chain constant region was linked with the OKT3 light chain variable region (OKT3VL0000, SEQ ID NO: 1012) to produce an OKT3 light chain variant, and an expression vector encoding the corresponding gene was produced by a method known to the person skilled in the art.

TABLE 46

| Variant of OKT3 light chain constant region | Position of cysteine substitution (Kabat numbering) | SEQ ID NO: |
|---|---|---|
| KT0.K126C | 126 | 1020 |

The above-produced OKT3 heavy chain variants and OKT3 light chain variant were each combined with the OKT3 light chain and OKT3 heavy chain, and the OKT3 variants shown in Table 47 were expressed by transient expression using FreeStyle293 cells (Invitrogen) or Expi293 cells (Life technologies) by a method known to the person skilled in the art, and purified with Protein A by a method known to the person skilled in the art. Further, an anti-KLH antibody, IC17 ((heavy chain: IC17HdK-GIT4 (SEQ ID NO: 1013), light chain: IC17L-k0 (SEQ ID NO: 1014)) was similarly prepared as a negative control.

TABLE 47

| Antibody name | Heavy chain variable region SEQ ID NO: | Heavy chain constant region SEQ ID NO: | Light chain variable region SEQ ID NO: | Light chain constant region SEQ ID NO: |
|---|---|---|---|---|
| H_T135C | 1010 | 1017 | 1012 | 1011 |
| H_S136C | 1010 | 1018 | 1012 | 1011 |
| H_S191C | 1010 | 1019 | 1012 | 1011 |
| L_K126C | 1010 | 1009 | 1012 | 1020 |

Example 13-2 Preparation of Jurkat Cell Suspension

Jurkat cells (TCR/CD3 Effector Cells (NFAT), Promega) were collected from flasks. The cells were washed with Assay Buffer (RPMI 1640 medium (Gibco), 10% FBS (HyClone), 1% MEM Non Essential Amino Acids (Invitrogen), and 1 mM Sodium Pyruvate (Invitrogen)), and then suspended at $3 \times 10^6$ cells/mL in Assay Buffer. This suspension of Jurkat cells was subjected to subsequent experiments.

Example 13-3 Preparation of Luminescence Reagent Solution 100 mL of Bio-Glo Luciferase Assay Buffer (Promega) was added to the bottle of Bio-Glo Luciferase Assay Substrate (Promega), and mixed by inversion. The bottle was protected from light and frozen at $-20°$ C. This luminescence reagent solution was subjected to subsequent experiments.

Example 13-4 Assessment of T Cell Activation of Antibodies Having Cysteine Substitution at the Constant Region T cell activation by agonist signaling was assessed based on the fold change of luciferase luminescence. The aforementioned Jurkat cells are cells transformed with a luciferase reporter gene having an NFAT responsive sequence. When the cells are stimulated by an anti-TCR/CD3 antibody, the NFAT pathway is activated via intracellular signaling, thereby inducing luciferase expression. The Jurkat cell suspension prepared as described above was added to a 384-well flat-bottomed white plate at 10 µL per well ($3 \times 10^4$ cells/well). Next, the antibody solution prepared at each concentration (10,000, 1,000, 100, 10, 1, and 0.1 ng/mL) was added at 20 µL per well. This plate was allowed to stand in a 5% $CO_2$ incubator at 37° C. for 24 hours. After the incubation, the luminescence reagent solution was thawed, and 30 µL of the solution was added to each well. The plate was then allowed to stand at room temperature for 10 minutes. Luciferase luminescence in each well of the plate was measured using a luminometer. The amount of luminescence (fold) was determined by dividing the amount of luminescence in the wells added with the antibody with the amount of luminescence in the wells lacking the antibody.

Figure 26:
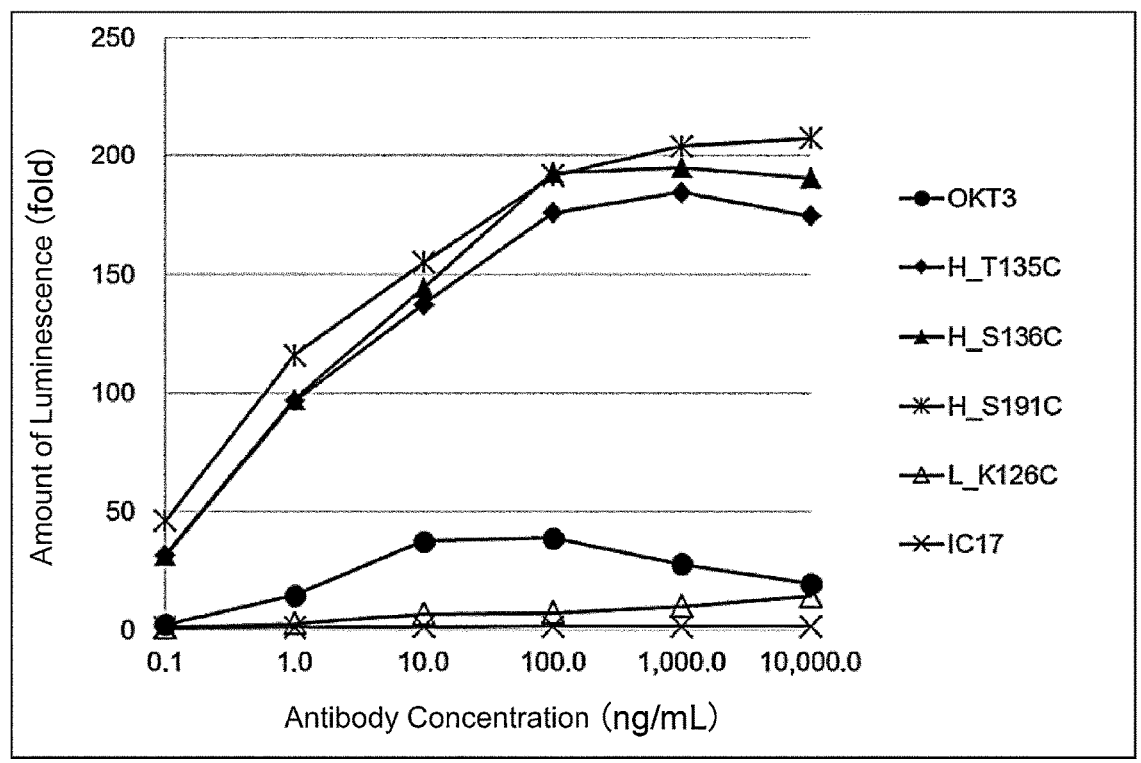
FIG. 26 shows the results of assaying the CD3-mediated agonist activity of an anti-CD3 antibody molecule (OKT3), modified antibody molecules produced by linking the Fab-Fab of that antibody molecule via an additional disulfide bond (H_T135C, H_S136C, H_S191C, and L_K126C), and an anti-KLH antibody molecule (IC17) (negative control), as described in Example 13-4.

As a result, among the OKT3 variants having cysteine substitution at the constant region, multiple variants greatly increased the T cell activated state as compared to OKT3 as shown in FIG. 26. This result shows that there are multiple cysteine modifications that can crosslink Fabs and enhance CD3 agonist activities.

Example 14 Assessment of CD3 Agonist Activity of Antibodies Having Different Cysteine Substitutions in the Two Fabs

Example 14-1 Production of Antibodies Having Heterologous Cysteine Substitution at the Constant Region An anti-human CD3 agonist antibody, OKT3 (heavy chain: OKT3VH0000-G1T4 (SEQ ID NO: 1007), light chain: OKT3VL0000-KT0 (SEQ ID NO: 1008)), was subjected to a study in which an arbitrary amino acid residue structurally exposed to the surface was substituted with cysteine.

An amino acid residue within the OKT3 heavy chain constant region 1 (G1T4k, SEQ ID NO: 1015) was substituted with cysteine to produce a variant of the OKT3 heavy chain constant region shown in Table 48. This variant of the OKT3 heavy chain constant region was linked with the OKT3 heavy chain variable region (OKT3VH0000, SEQ ID NO: 1010) to produce OKT3 heavy chain variant 1, and an expression vector encoding the corresponding gene was produced by a method known to the person skilled in the art. Similarly, amino acid residues within the OKT3 heavy chain constant region 2 (G1T4h, SEQ ID NO: 1016) were substituted with cysteine to produce variants of the OKT3 heavy chain constant region shown in Table 49. These variants of the OKT3 heavy chain constant region were each linked with the OKT3 heavy chain variable region (OKT3VH0000, SEQ ID NO: 1010) to produce OKT3 heavy chain variant 2, and expression vectors encoding the corresponding genes were produced by a method known to the person skilled in the art. It is noted that heavy-chain constant regions 1 and 2 in this Example are introduced with the Knobs-into-Holes (KiH) modification at the CH3 region for promoting heterodimerization.

TABLE 48

| Variant of OKT3 heavy chain constant region 1 | Position of cysteine substitution (EU numbering) | SEQ ID NO: |
|---|---|---|
| G1T4k.S191C | 191 | 1022 |

TABLE 49

| Variant of OKT3 heavy chain constant region 2 | Position of cysteine substitution (EU numbering) | SEQ ID NO: |
|---|---|---|
| G1T4h.V188C | 188 | 1023 |
| G1T4h.P189C | 189 | 1024 |
| G1T4h.S190C | 190 | 1025 |
| G1T4h.S191C | 191 | 1026 |
| G1T4h.S192C | 192 | 1027 |
| G1T4h.L193C | 193 | 1028 |
| G1T4h.G194C | 194 | 1029 |

The above-produced OKT3 heavy chain variant 1 and OKT3 heavy chain variant 2 were combined with the OKT3 light chain, and the OKT3 variants shown in Table 50 were expressed by transient expression using FreeStyle293 cells (Invitrogen) or Expi293 cells (Life technologies) by a method known to the person skilled in the art, and purified with Protein A by a method known to the person skilled in the art. Further, an anti-KLH antibody, IC17 (heavy chain: IC17HdK-G1T4 (SEQ ID NO: 1013), light chain: IC17L-k0 (SEQ ID NO: 1014)) was similarly prepared as a negative control.

TABLE 50

| Antibody name | Heavy chain variant 1 | | Heavy chain variant 2 | | | |
|---|---|---|---|---|---|---|
| | Heavy chain variable region SEQ ID NO: | Heavy chain constant region SEQ ID NO: | Heavy chain variable region SEQ ID NO: | Heavy chain constant region SEQ ID NO: | Light chain variable region SEQ ID NO: | Light chain constant region SEQ ID NO: |
| OKT3_KiH | 1010 | 1015 | 1010 | 1016 | 1012 | 1011 |
| H_S191C_KiH | 1010 | 1022 | 1010 | 1026 | 1012 | 1011 |
| H_S191C/V188C_KiH | 1010 | 1022 | 1010 | 1023 | 1012 | 1011 |
| H_S191C/P189C_KiH | 1010 | 1022 | 1010 | 1024 | 1012 | 1011 |
| H_S191C/S190C_KiH | 1010 | 1022 | 1010 | 1025 | 1012 | 1011 |
| H_S191C/S192C_KiH | 1010 | 1022 | 1010 | 1027 | 1012 | 1011 |
| H_S191C/L193C_KiH | 1010 | 1022 | 1010 | 1028 | 1012 | 1011 |
| H_S191C/G194C_KiH | 1010 | 1022 | 1010 | 1029 | 1012 | 1011 |

Example 14-2 Preparation of Jurkat Cell Suspension

Jurkat cell suspension was prepared as in Example 13-2.

Example 14-3 Preparation of Luminescence Reagent Solution

Luminescence reagent solution was prepared as in Example 13-3.

Example 14-4 Assessment of T Cell Activation of Antibodies Having Heterologous Cysteine Substitution at the Constant Region T cell activation was assessed as in Example 13-4.

Figure 27:
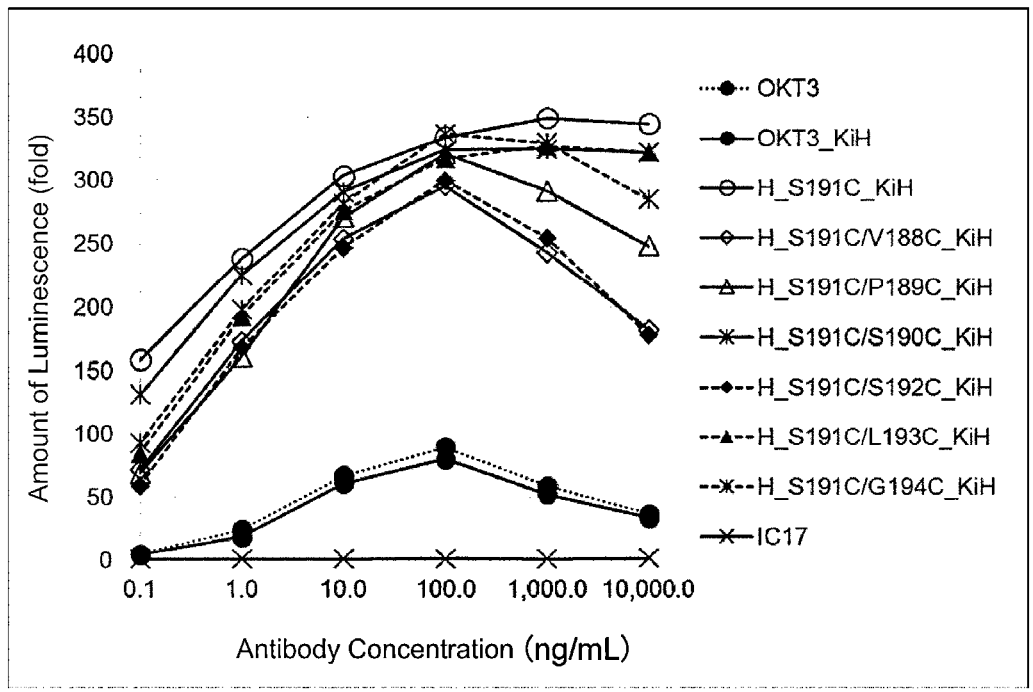
FIG. 27 shows the results of assaying the CD3-mediated agonist activity of an anti-CD3 antibody molecule (OKT3), a modified antibody molecule produced by introducing Knobs-into-Holes (KiH) modifications, which facilitate heterodimerization, into the heavy chain constant region of OKT3 (OKT3_KiH), modified antibody molecules produced by linking the Fab-Fab of that antibody molecule via an additional disulfide bond (H_S191C_KiH, H_S191CN188C_KiH,H_S191C/P189C_KiH,H_S191C/S190C_KiH, H_S191C/S192C_KiH, H_S191C/L193C_KiH, H_S191C/G194C_KiH), and an anti-KLH antibody (IC17) (negative control), as described in Example 14-4.

As a result, OKT3 variants having different cysteine substitutions at the two constant regions of the antibody greatly increased the T cell activated state as compared to OKT3, as shown in FIG. 27. This result shows that even different cysteine substitutions between the Fabs can crosslink Fabs and enhance CD3 agonist activities.

Example 15 Assessment of CD3 Agonist Activity of Antibodies Having Charge Modification within the Fab

Example 15-1 Production of Antibodies Having Charged Amino Acid Substitution at the Constant Region The heavy chain of an anti-human CD3 agonist antibody, OKT3 (heavy chain: OKT3VH0000-G1T4 (SEQ ID NO: 1007), light chain: OKT3VL0000-KT0 (SEQ ID NO: 1008)), was subjected to a study in which an arbitrary amino acid residue structurally exposed to the surface was substituted with charged amino acid.

Amino acid residues within the OKT3 heavy chain constant region 1 (G1T4k, SEQ ID NO: 1015) were substituted with arginine (R) or lysine (K) to produce a variant of the OKT3 heavy chain constant region shown in Table 51. This variant of the OKT3 heavy chain constant region was linked with the OKT3 heavy chain variable region (OKT3VH0000, SEQ ID NO: 1010) to produce OKT3 heavy chain variant 1, and an expression vector encoding the corresponding gene was produced by a method known to the person skilled in the art. Similarly, amino acid residues within the OKT3 heavy chain constant region 2 (G1T4h, SEQ ID NO: 1016) were substituted with aspartic acid (D) or glutamic acid (E) to produce variants of the OKT3 heavy chain constant region shown in Table 52. These variants of the OKT3 heavy chain constant region were each linked with the OKT3 heavy chain variable region (OKT3VH0000, SEQ ID NO: 1010) to produce OKT3 heavy chain variant 2, and expression vectors encoding the corresponding genes were produced by a method known to the person skilled in the art. It is noted that the CH3 regions of heavy chain constant regions 1 and 2 in this Example are introduced with the Knobs-into-Holes (KiH) modification for promoting heterodimerization.

TABLE 51

| Variant of OKT3 heavy chain constant region 1 | Amino acid modification (EU numbering) | SEQ ID NO: |
|---|---|---|
| G1T4k0004 | S134R/T135R/S136R/G137R/S191R/ S192R/L193R/G194R/T195R/Q196R | 1030 |

TABLE 52

| Variant of OKT3 heavy chain constant region 2 | Amino acid modification (EU numbering) | SEQ ID NO: |
|---|---|---|
| G1T4h0004 | S134D/T135D/S136D/G137D/S191D/ S192D/L193D/G194D/T195D/Q196D | 1031 |
| G1T4h0006 | S134E/T135E/S136E/G137E/S191E/ S192E/L193E/G194E/T195E/Q196E | 1032 |

The above-produced OKT3 heavy chain variant 1 and OKT3 heavy chain variant 2 were combined with the OKT3 light chain, and the OKT3 variants shown in Table 53 were expressed by transient expression using FreeStyle293 cells (Invitrogen) or Expi293 cells (Life technologies) by a method known to the person skilled in the art, and purified with Protein A by a method known to the person skilled in the art. Further, an anti-KLH antibody, IC17 (heavy chain: IC17HdK-G1T4 (SEQ ID NO: 1013), light chain: IC17L-k0 (SEQ ID NO: 1014)) was similarly prepared as a negative control.

TABLE 53

| Antibody name | Heavy chain variant 1 | | Heavy chain variant 2 | | | |
|---|---|---|---|---|---|---|
| | Heavy chain variable region SEQ ID NO: | Heavy chain constant region SEQ ID NO: | Heavy chain variable region SEQ ID NO: | Heavy chain constant region SEQ ID NO: | Light chain variable region SEQ ID NO: | Light chain constant region SEQ ID NO: |
| OKT3_KiH | 1010 | 1015 | 1010 | 1016 | 1012 | 1011 |
| 0004//0004 | 1010 | 1030 | 1010 | 1031 | 1012 | 1011 |
| 0004//0006 | 1010 | 1030 | 1010 | 1032 | 1012 | 1011 |
| 0004//OKT3 | 1010 | 1030 | 1010 | 1016 | 1012 | 1011 |
| OKT3//0004 | 1010 | 1015 | 1010 | 1031 | 1012 | 1011 |
| OKT3//0006 | 1010 | 1015 | 1010 | 1032 | 1012 | 1011 |

Jurkat cell suspension was prepared as in Example 13-2.

Example 15-3 Preparation of Luminescence Reagent Solution

Luminescence reagent solution was prepared as in Example 13-3.

Example 15-4 Assessment of T Cell Activation of Antibodies Having Substitution with Amino Acids Other than Cysteine at the Constant Region T cell activation was assessed as in Example 13-4.

Figure 28:
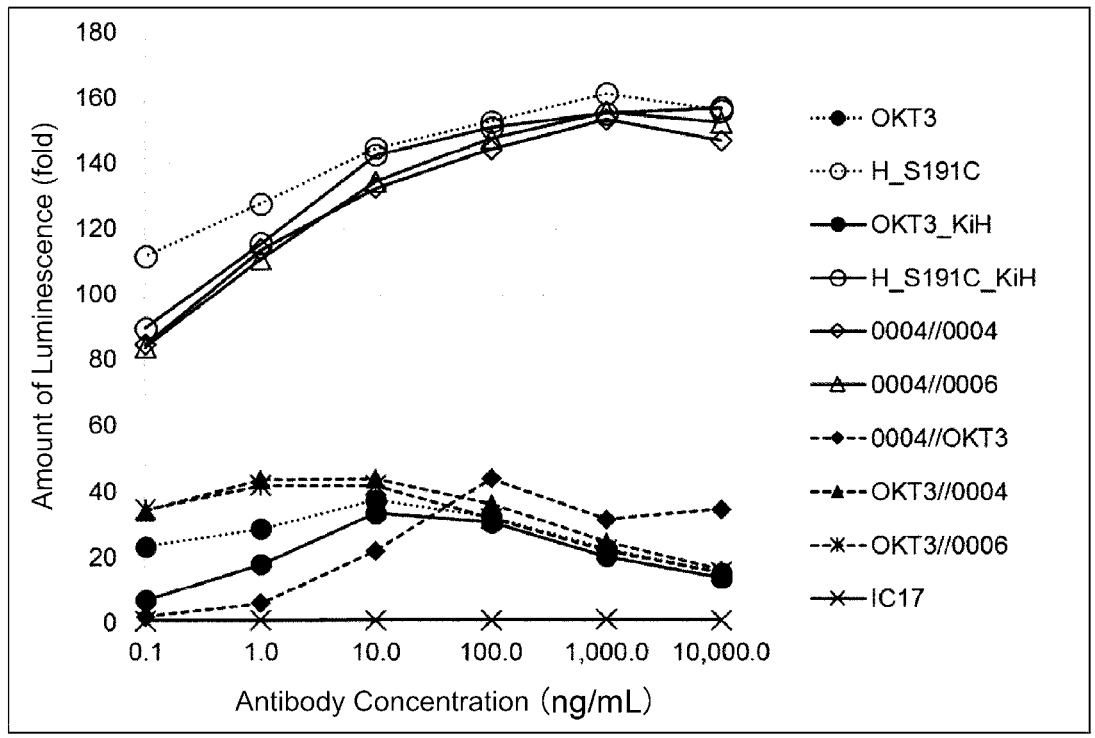
FIG. 28 shows the results of assaying the CD3-mediated agonist activity of an anti-CD3 antibody molecule (OKT3), a modified antibody molecule produced by linking the Fab-Fab of that antibody molecule via an additional disulfide bond (H_S191C), a modified antibody molecule produced by introducing Knobs-into-Holes (KiH) modifications, which facilitate heterodimerization, into the heavy chain constant region of OKT3 (OKT3_KiH), a modified antibody molecule produced by linking the Fab-Fab of that antibody molecule via an additional disulfide bond (H_S191C_KiH), modified antibody molecules produced by introducing a positively-charged amino acid substitution into one of the heavy chain constant regions of OKT3_KiH and introducing a negatively-charged amino acid substitution into the other heavy chain constant region (0004//0004, 0004//0006), modified antibody molecules produced by introducing a positively- or negatively-charged amino acid substitution into one of the heavy chain constant regions of OKT3_KiH (0004//OKT3, OKT3//0004, OKT3//0006), and an anti-KLH antibody molecule (IC17) (negative control), as described in Example 15-4.

As a result, OKT3 variants introduced with positively charged amino acid substitution at one constant region and with negatively charged amino acid substitution at the other constant region greatly increased the T cell activated state as compared to OKT3 as shown in FIG. 28. Meanwhile, OKT3 variants introduced with positively or negatively charged amino acid substitution at one constant region and with no modification at the other constant region hardly changed the T cell activated state as compared to OKT3. This result shows that not only cysteine substitution but also charged amino acid substitution can crosslink Fabs by noncovalent bond and enhance CD3 agonist activities.

Example 16 Assessment of CD3 Agonist Activity of Antibodies Having Cysteine Substitution within the Fab and Lacking Disulfide Bonds in the Hinge Region Example 16-1 Production of Antibodies Having Cysteine Substitution within the Fab and Lacking Disulfide Bonds in the Hinge Region The heavy chain of an anti-human CD3 agonist antibody, OKT3 (heavy chain: OKT3VH0000-G1T4 (SEQ ID NO: 1007), light chain: OKT3VL0000-KT0 (SEQ ID NO: 1008)), was subjected to a study in which the disulfide bonds in the hinge region were removed and an amino acid residue structurally exposed to the surface was substituted with cysteine.

Cysteine in the hinge region of OKT3 heavy chain constant region (G1T4, SEQ ID NO: 1009) was substituted with serine to produce variants of the OKT3 heavy chain constant region shown in Table 54. The amino acid residue at position 191 (EU numbering) of these variants of OKT3 heavy chain constant region was substituted with cysteine to produce variants of the OKT3 heavy chain constant region shown in Table 55. These variants of the OKT3 heavy chain constant region were each linked with the OKT3 heavy chain variable region (OKT3VH0000, SEQ ID NO: 1010) to produce OKT3 heavy chain variants, and expression vectors encoding the corresponding genes were produced by a method known to the person skilled in the art.

TABLE 54

| Variant of OKT3 heavy chain constant region | Amino acid modification (EU numbering) | SEQ ID NO: |
|---|---|---|
| G1T4.dh1 | C226S | 1033 |
| G1T4.dh2 | C229S | 1034 |
| G1T4.dh3 | C226S/C229S | 1035 |

TABLE 55

| Variant of OKT3 heavy chain constant region | Amino acid modification (EU numbering) | SEQ ID NO: |
|---|---|---|
| G1T4.S191C.dh1 | S191C/C226S | 1036 |
| G1T4.S191C.dh2 | S191C/C229S | 1037 |
| G1T4.S191C.dh3 | S191C/C226S/C229S | 1038 |

The above-produced OKT3 heavy chain variants were combined with the OKT3 light chain, and the OKT3 variants shown in Table 56 were expressed by transient expression using FreeStyle293 cells (Invitrogen) or Expi293 cells (Life technologies) by a method known to the person skilled in the art, and purified with Protein A by a method known to the person skilled in the art. Further, an anti-KLH antibody, IC17 (heavy chain: IC17HdK-G1T4 (SEQ ID NO: 1013), light chain: IC17L-k0 (SEQ ID NO: 1014)) was similarly prepared as a negative control.

TABLE 56

| Antibody name | Heavy chain variable region SEQ ID NO: | Heavy chain constant region SEQ ID NO: | Light chain variable region SEQ ID NO: | Light chain constant region SEQ ID NO: |
|---|---|---|---|---|
| dh1 | 1010 | 1033 | 1012 | 1011 |
| dh2 | 1010 | 1034 | 1012 | 1011 |
| dh3 | 1010 | 1035 | 1012 | 1011 |
| H_S191C_dh1 | 1010 | 1036 | 1012 | 1011 |
| H_S191C_dh2 | 1010 | 1037 | 1012 | 1011 |
| H_S191C_dh3 | 1010 | 1038 | 1012 | 1011 |

Example 16-2 Preparation of Jurkat Cell Suspension

Jurkat cell suspension was prepared as in Example 13-2.

Example 16-3 Preparation of Luminescence Reagent Solution

Luminescence reagent solution was prepared as in Example 13-3.

Example 16-4 Assessment of T Cell Activation of Antibodies Having Cysteine Substitution within the Fab and Lacking Disulfide Bonds in the Hinge Region T cell activation was assessed as in Example 13-4.

Figure 29:
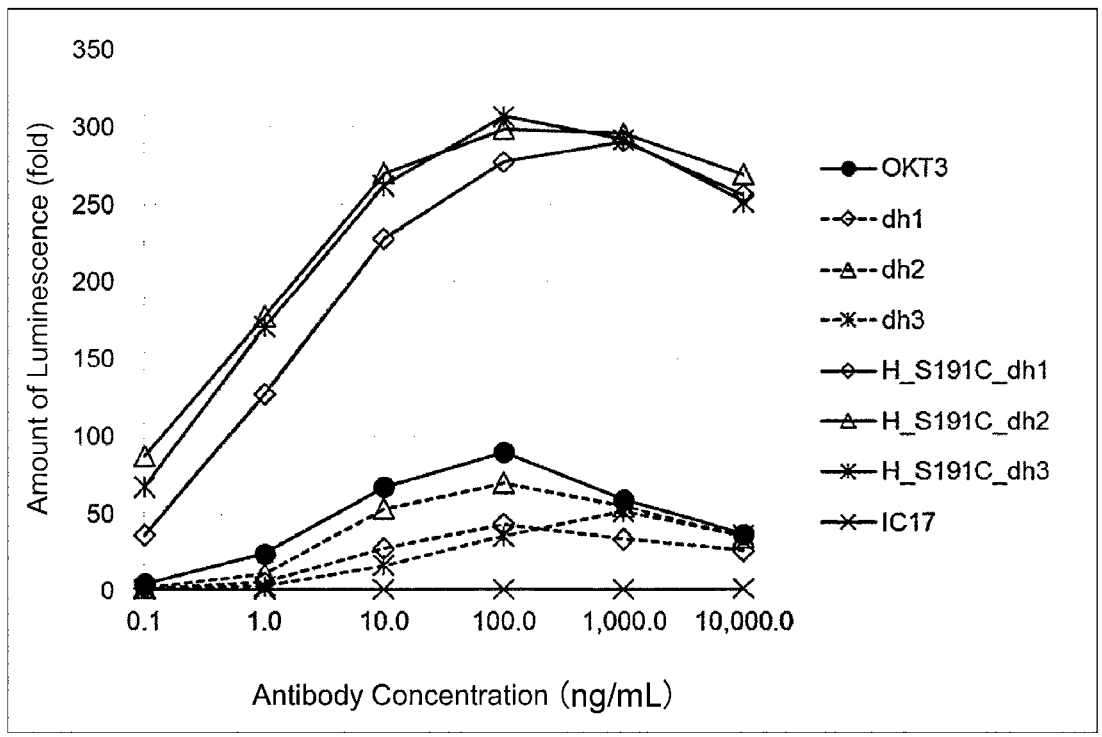
FIG. 29 shows the results of assaying the CD3-mediated agonist activity of an anti-CD3 antibody molecule (OKT3), modified antibody molecules produced by removing a disulfide bond in the hinge region of that antibody molecule (dh1, dh2, dh3), modified antibody molecules produced by linking the Fab-Fab of those molecules via an additional disulfide bond (H_S191C_dh1, H_S191C_dh2, H_S191C_dh3), and an anti-KLH antibody molecule (IC17) (negative control) as described in Example 16-4.

As a result, OKT3 variants with only the disulfide bonds in the hinge region removed reduced or hardly changed the T cell activated state as compared to OKT3 as shown in FIG. 29. On the other hand, OKT3 variants with the disulfide bonds in the hinge region removed and introduced with cysteine substitution at the constant region greatly increased the T cell activated state as compared to OKT3. This result shows that even when there is no disulfide bond in the hinge region, cysteine substitution within the Fab can crosslink Fabs and enhance CD3 agonist activities.

Example 17 Production of Expression Vectors for Modified Antibodies, and Expression and Purification of Modified Antibodies An antibody gene inserted in an expression vector for animal cells was subjected to amino acid residue sequence substitution by a method known to the person skilled in the art using PCR, the In-Fusion Advantage PCR cloning kit (TAKARA), or such, to construct an expression vector for a modified antibody. The nucleotide sequence of the resulting expression vector was determined by a method known to the person skilled in the art. The produced expression vector was transiently introduced into FreeStyle293® or Expi293® cells (Invitrogen) and the cells were allowed to express the modified antibody into culture supernatant. The modified antibody was purified from the obtained culture supernatant by a method known to the person skilled in the art using Protein A and such. Absorbance at 280 nm was measured using a spectrophotometer. An absorption coefficient was calculated from the measured value using the PACE method and used to calculate the antibody concentration (Protein Science 1995; 4:2411-2423).

Example 18 Preparation of Bispecific Antibodies

The purified antibody was dialyzed into TBS or PBS buffer and its concentration was adjusted to 1 mg/mL. As a 10× reaction buffer, 250 mM 2-MEA (SIGMA) was prepared. Two different homodimeric antibodies prepared in Example 17 were mixed in equal amount. To this mixture, a 1/10 volume of the 10× reaction buffer was added and mixed. The mixture was allowed to stand at 37° C. for 90 minutes. After the reaction, the mixture was dialyzed into TBS or PBS to obtain a solution of a bispecific antibody in which the above two different antibodies were heterodimerized. The antibody concentration was measured by the above-mentioned method, and the antibody was subjected to subsequent experiments.

Example 19 Assessment of Agonist Activity

Example 19-1 Preparation of Jurkat Cell Suspension

Jurkat cells (TCR/CD3 Effector Cells (NFAT), Promega) were collected from flasks. The cells were washed with Assay Buffer (RPMI 1640 medium (Gibco), 10% FBS (HyClone), 1% MEM Non Essential Amino Acids (Invitrogen), and 1 mM Sodium Pyruvate (Invitrogen)), and then suspended at $3 \times 10^6$ cells/mL in Assay Buffer. This suspension of Jurkat cells was subjected to subsequent experiments.

Example 19-2 Preparation of Luminescence Reagent Solution 100 mL of Bio-Glo Luciferase Assay Buffer (Promega) was added to the bottle of Bio-Glo Luciferase Assay Substrate (Promega), and mixed by inversion. The bottle was protected from light and frozen at −20° C. This luminescence reagent solution was subjected to subsequent experiments.

Example 19-3 T Cell Activation Assay

T cell activation by agonist signaling was assessed based on the fold change of luciferase luminescence. The aforementioned Jurkat cells are cells transformed with a luciferase reporter gene having an NFAT responsive sequence. When the cells are stimulated by an anti-TCR/CD3 antibody, the NFAT pathway is activated via intracellular signaling, thereby inducing luciferase expression. The Jurkat cell suspension prepared as described above was added to a 384-well flat-bottomed white plate at 10 μL per well ($3 \times 10^4$ cells/well). Next, the antibody solution prepared at each concentration (150, 15, 1.5, 0.15, 0.015, 0.0015, 0.00015, and 0.000015 nM) was added at 20 μL per well. This plate was allowed to stand in a 5% $CO_2$ incubator at 37° C. for 24 hours. After the incubation, the luminescence reagent solution was thawed, and 30 μL of the solution was added to each well. The plate was then allowed to stand at room temperature for 10 minutes. Luciferase luminescence in each well of the plate was measured using a luminometer.

Example 20 Assessment of Agonist Activity of CD3 Biparatopic Antibodies Using Jurkat Cells Antibodies were prepared and their activities were assessed according to Examples 17, 18, and 19. The antibodies used in this Example are shown in Table 57.

TABLE 57

| Antibody name | SEQ ID NO (Antibody 1): Heavy chain | SEQ ID NO (Antibody 1): Light chain | SEQ ID NO (Antibody 2): Heavy chain | SEQ ID NO (Antibody 2): Light chain | Molecular form |
|---|---|---|---|---|---|
| CD3-G1sLL | 1039 | 1040 | — | — | Monospecific antibody |
| CD3//OKT3-G1s | 1041 | 1042 | 1043 | 1044 | Bispecific antibody |
| CD3//OKT3-G1sHH | 1045 | 1046 | 1047 | 1048 | Bispecific antibody |
| CD3//OKT3-G1sLH | 1049 | 1050 | 1051 | 1052 | Bispecific antibody |
| OKT3-G1s | 1053 | 1054 | — | — | Monospecific antibody |
| OKT3-G1sHH | 1055 | 1056 | — | — | Monospecific antibody |
| CD3-G1sLL + OKT3-G1s | 1057 | 1058 | 1059 | 1060 | Monospecific antibody |

Figure 30:
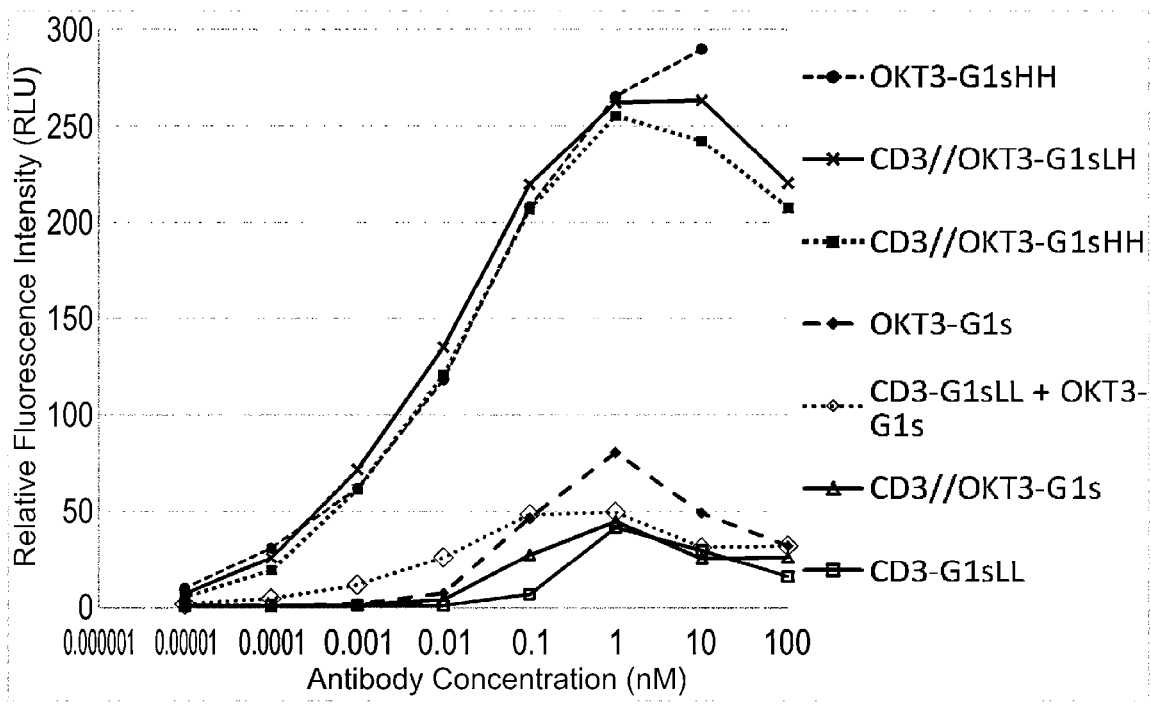
FIG. 30 shows the results of assaying the CD3-mediated agonist activity of an anti-CD3 monospecific antibody molecule (OKT3-G1s), a modified antibody molecule produced by linking the Fab-Fab of that antibody molecule via an additional disulfide bond (OKT3-G1sHH), a modified antibody molecule produced by linking the Fab-Fab of an anti-CD3 monospecific antibody (CD3-G1s) via an additional disulfide bond (CD3-G1sLL), an anti-CD3 biparatopic antibody molecule (CD3//OKT3-G1s), modified antibody molecules produced by linking the Fab-Fab of that antibody molecule via an additional disulfide bond (CD3//OKT3-G1sHH, CD3//OKT3-G1sLH), and a combination of CD3-G1sLL and OKT3-G1s (CD3-G1sLL+OKT3-G1s), as described in Example 20.
Figure 31A:
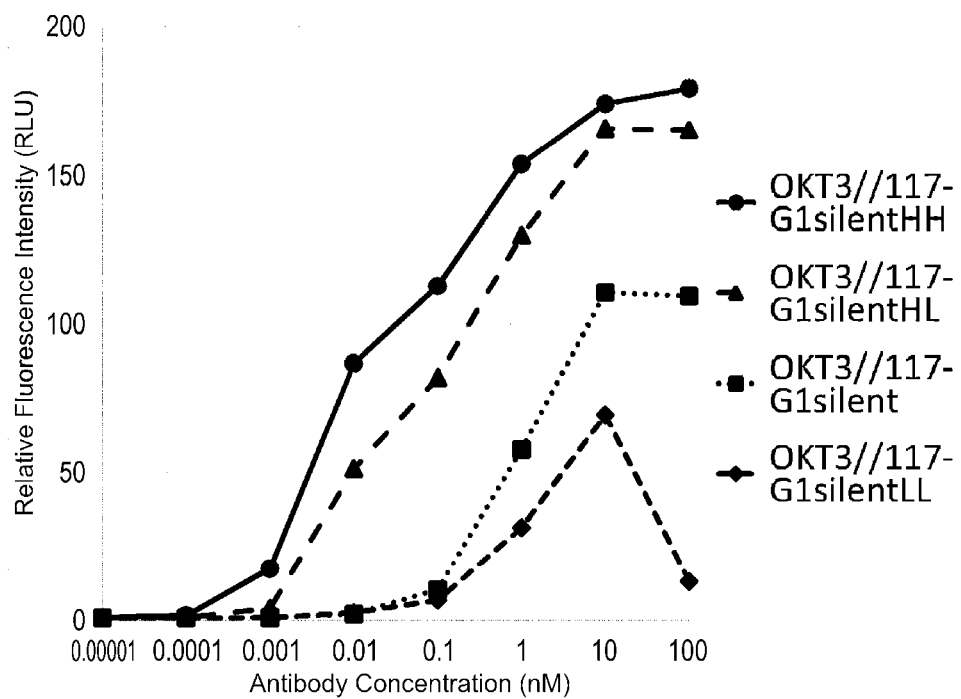
FIGS. 31A-D show the results of assaying the CD3- and/or PD1-mediated agonist activity of anti-CD3×anti-PD1 bispecific antibodies and modified antibody molecules produced by linking the Fab-Fab of those antibodies via an additional disulfide bond, as described in Example 22-1.
Figure 31B:
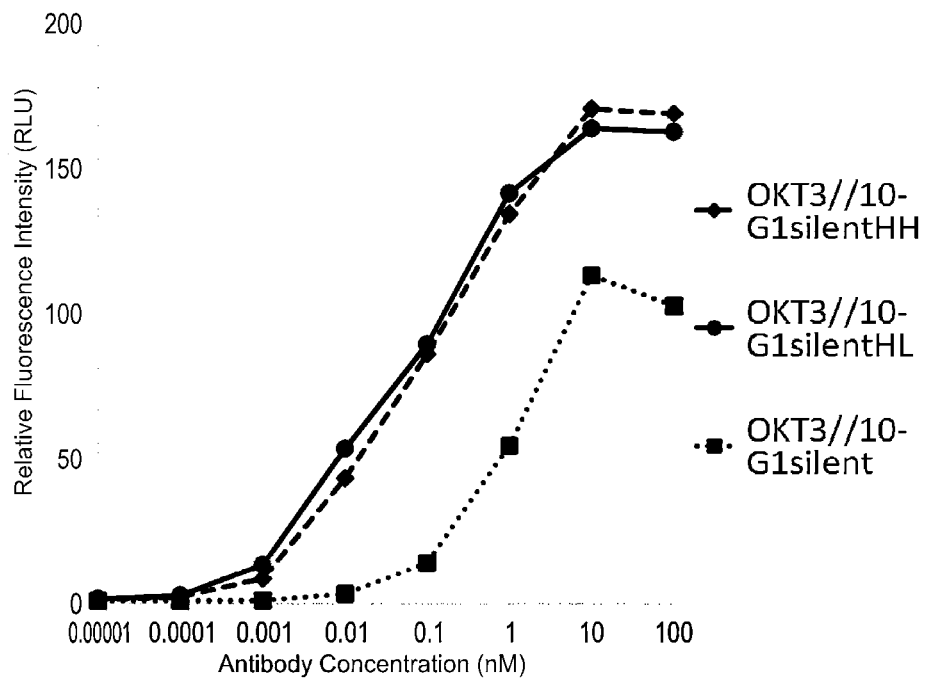
Figure 31C:
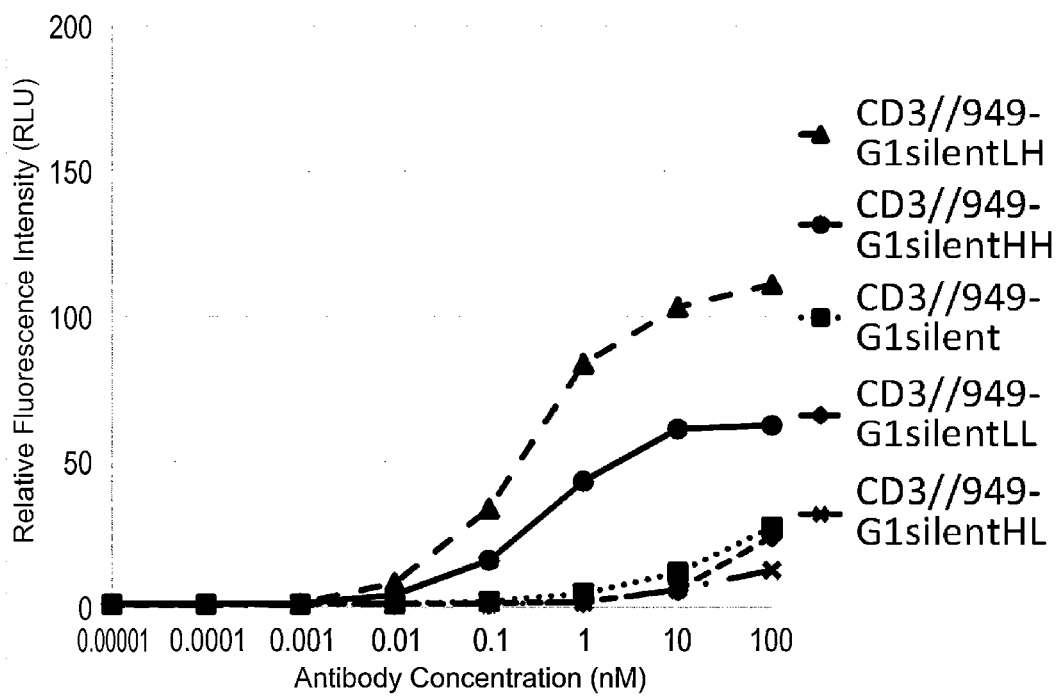
Figure 31D:
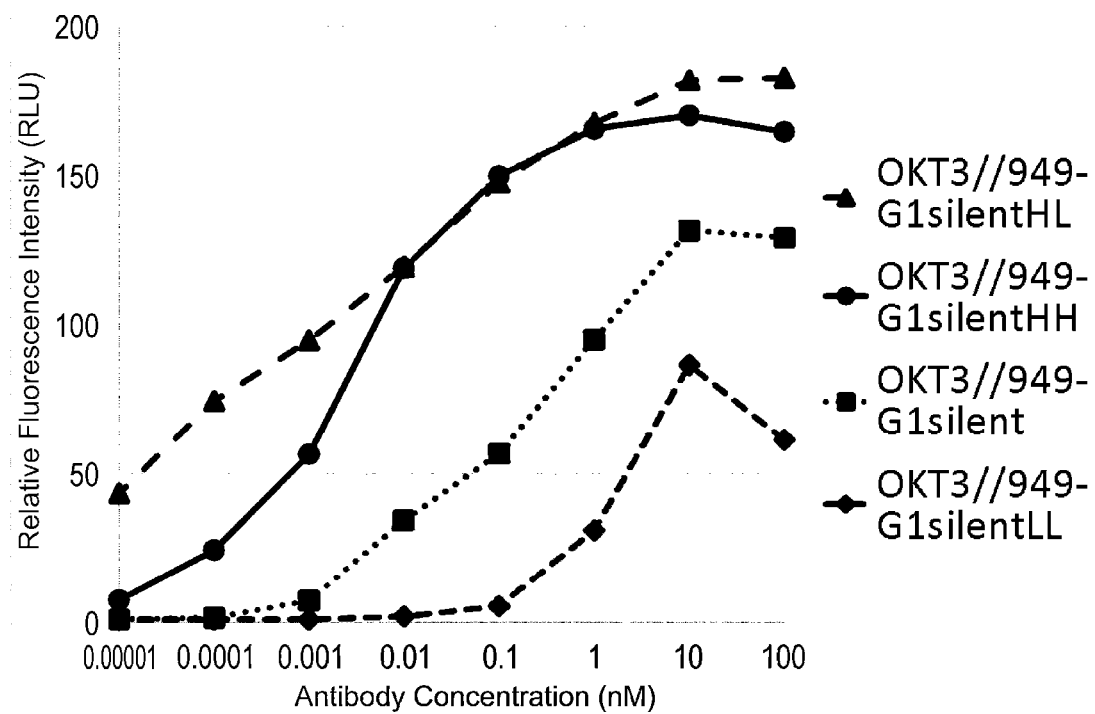

As a result, modified molecules with an additional disulfide bond linking the Fab-Fab of two types of anti-CD3 bispecific antibodies showed varied CD3-mediated signaling compared to bispecific antibodies lacking the additional disulfide bond as shown in FIG. 30.

This result suggests that introducing modifications of the present invention can enhance or diminish agonist activity possessed by bispecific antigen-binding molecules having different epitopes for the same target.

Example 21 Assessment of CD137 Agonist Activity Using Jurkat Cells

Antibodies were prepared and their activities were assessed according to Examples 17, 18, and 19. The antibodies used in this Example were as follows: an ordinary anti-CD137 antibody, an antibody introduced with a mutation that promotes association of antibodies (hexamerization) in its heavy-chain constant region, and modified antibodies produced by linking the Fab-Fab of each of the above antibodies with an additional disulfide bond.

T cell activation by agonist signaling was assessed based on the fold change of luciferase luminescence. The cells of GloResponse™ NF-xB-Luc2/4-1BB Jurkat cell line (Promega) are cells transformed with a luciferase reporter gene having an NFAT responsive sequence. When the cells are stimulated by an anti-CD137 antibody, the NFAT pathway is activated via intracellular signaling, thereby inducing luciferase expression. The Jurkat cell suspension prepared at $2\times10^6$ cells/mL with Assay medium (99% RPMI, 1% FBS) was added to a 96-well flat-bottomed white plate at 25 μL per well ($5\times10^4$ cells/well). Next, the antibody solution containing ATP or the antibody solution without ATP prepared at each antibody concentration (final concentration: 45, 15, 5, 1.667, 0.556, 0.185, 0.062, and 0.021 μg/mL) was added at 25 μL per well. The final concentration of ATP was 250 nM. This plate was allowed to stand in a 5% C02 incubator at 37° C. for 6 hours. After the incubation, the luminescence reagent solution was thawed, and 75 μL of the solution was added to each well. The plate was then allowed to stand at room temperature for 10 minutes. Luciferase luminescence in each well of the plate was measured using a luminometer. The value of the luminescence of each well divided by the value of the luminescence of the well without antibody addition was defined as Luminescence fold, and it served as an indicator for assessing the activity of each antibody.

As a result, antibodies introduced with the hexamerization modification showed increased agonist activity as compared to an ordinary anti-CD137 antibody. Further, in modified antibodies where each of the antibodies was introduced with additional disulfide bonds, synergistic increase in agonist activity was observed.

This result suggests that introducing modifications of the present invention can enhance the activity of an anti-CD137 agonist antibody.

Example 22 Assessment of Agonist Activity of CD3//PD1 Bispecific Antibodies Using Jurkat cells Example 22-1

Antibodies were prepared and their activities were assessed according to Examples 17, 18, and 19 The antibodies need in thig Fnmple are shown in Table 59.

TABLE 59

| Antibody name | SEQ ID NO (Antibody 1): Heavy chain | SEQ ID NO (Antibody 1): Light chain | SEQ ID NO (Antibody 2): Heavy chain | SEQ ID NO (Antibody 2): Light chain | Molecular form |
|---|---|---|---|---|---|
| OKT3//117-G1silent | 1113 | 1114 | 1115 | 1116 | Bispecific antibody |
| OKT3//117-G1silentLL | 1117 | 1118 | 1119 | 1120 | Bispecific antibody |
| OKT3//117-G1silentHH | 1121 | 1122 | 1123 | 1124 | Bispecific antibody |
| OKT3//117-G1silentHL | 1125 | 1126 | 1127 | 1128 | Bispecific antibody |
| OKT3//10-G1silent | 1129 | 1130 | 1131 | 1132 | Bispecific antibody |
| OKT3//10-G1silentHH | 1133 | 1134 | 1135 | 1136 | Bispecific antibody |
| OKT3//10-G1silentHL | 1137 | 1138 | 1139 | 1140 | Bispecific antibody |
| CD3//949-G1silent | 1141 | 1142 | 1143 | 1144 | Bispecific antibody |
| CD3//949-G1silentLL | 1145 | 1146 | 1147 | 1148 | Bispecific antibody |
| CD3//949-G1silentHH | 1149 | 1150 | 1151 | 1152 | Bispecific antibody |
| CD3//949-G1silentLH | 1153 | 1154 | 1155 | 1156 | Bispecific antibody |
| CD3//949-G1silentHL | 1157 | 1158 | 1159 | 1160 | Bispecific antibody |
| OKT3//949-G1silent | 1161 | 1162 | 1163 | 1164 | Bispecific antibody |
| OKT3//949-G1silentLL | 1165 | 1166 | 1167 | 1168 | Bispecific antibody |

TABLE 59-continued

|  | SEQ ID NO (Antibody 1): | | SEQ ID NO (Antibody 2): | | |
|---|---|---|---|---|---|
| Antibody name | Heavy chain | Light chain | Heavy chain | Light chain | Molecular form |
| OKT3//949-G1silentHH | 1169 | 1170 | 1171 | 1172 | Bispecific antibody |
| OKT3//949-G1silentHL | 1173 | 1174 | 1175 | 1176 | Bispecific antibody |

As a result, in multiple bispecific antibodies consisting of a combination of an anti-CD3 antibody and an anti-PD1 antibody, modified molecules with an additional disulfide bond linking the Fab-Fab showed greatly varied CD3- and/or PD1-mediated signaling compared to bispecific antibodies lacking the additional disulfide bond as shown in FIG. 31.

This result suggests that introducing modifications of the present invention can enhance or diminish agonist activity possessed by antigen-binding molecules such as antibodies.

Example 22-2

Antibodies were prepared and their activities were assessed according to Examples 2, 3, and 4. The antibodies used in this Example are shown in Table 60.

TABLE 60

|  | SEQ ID NO (Antibody 1): | | SEQ ID NO (Antibody 2): | | |
|---|---|---|---|---|---|
| Antibody name | Heavy chain | Light chain | Heavy chain | Light chain | Molecular form |
| OKT3//949-G1silent | 1161 | 1162 | 1163 | 1164 | Bispecific antibody |
| OKT3//949-G1silentHH | 1169 | 1170 | 1171 | 1172 | Bispecific antibody |
| OKT3//949-G1silentHL | 1173 | 1174 | 1175 | 1176 | Bispecific antibody |
| OKT3//949-G1silentLL | 1165 | 1166 | 1167 | 1168 | Bispecific antibody |
| OKT3//949-G1silentLH | 1177 | 1178 | 1179 | 1180 | Bispecific antibody |

The presence or absence of PD-1 agonist signaling was assessed by the ratio of the fluorescent signal from BRET when PD-1 is in the vicinity of SHP2 (618 mu) and the luminescence originating from SHP2, which is the donor (460 nm). One day before the assay, antigen presenting cells expressing PD-L1 (Promega, #J109A) were seeded into F-12 medium containing 10% FBS (Gibco, 11765-054) in a 96-well plate (Costar, #3917) at $4.0 \times 10^4$ cells/100 μL/well, and the cells were cultured in a $CO_2$ incubator for 16-24 hours at 37° C. On the day of the assay, HaloTag nanoBRET 618 Ligand (Promega, #G980A) was diluted 250-fold with Opti-MEM (Gibco, #31985-062). The medium for culturing PD-L1-expressing antigen presenting cells were removed, and the diluted HaloTag nanoBRET 618 Ligand was added at 25 μL/well. The specimen for assessment diluted with Opti-MEM containing 10 μg/mL of PD-L1-inhibiting antibodies (40, 8, and 1.6 μg/mL) was added at 25 μL/well. PD-1/SHP2 Jurkat cells (Promega, #CS2009A01) were added to the above-noted 96-well plate at $5 \times 10^4$ cells/50 μL/well, thoroughly suspended, and then incubated in a $CO_2$ incubator for 2.5 hours at 37° C. nanoBRET Nano-Glo substrate (Promega, #N157A) was diluted 100-fold with Opti-MEM, and this was added at 25/IJwell to the 96-well plate after incubation. The plate was allowed to stand at room temperature for 30 minutes, and then the Em460 mM and Em618 nm were measured using Envision (PerkinElmer, 2104 EnVision). The obtained values were applied to the following equation to calculate the BRET Ratio (mBU).

$$\frac{618 \text{ nm}}{460 \text{ nm}} = BU, BU \times 1000 = mBU$$

Mean $mBU_{experimental}$ −

Mean $mBU_{no\ PD\_L1\ block\ control}$ = BRET Ratio (mBU)

Figure 32:
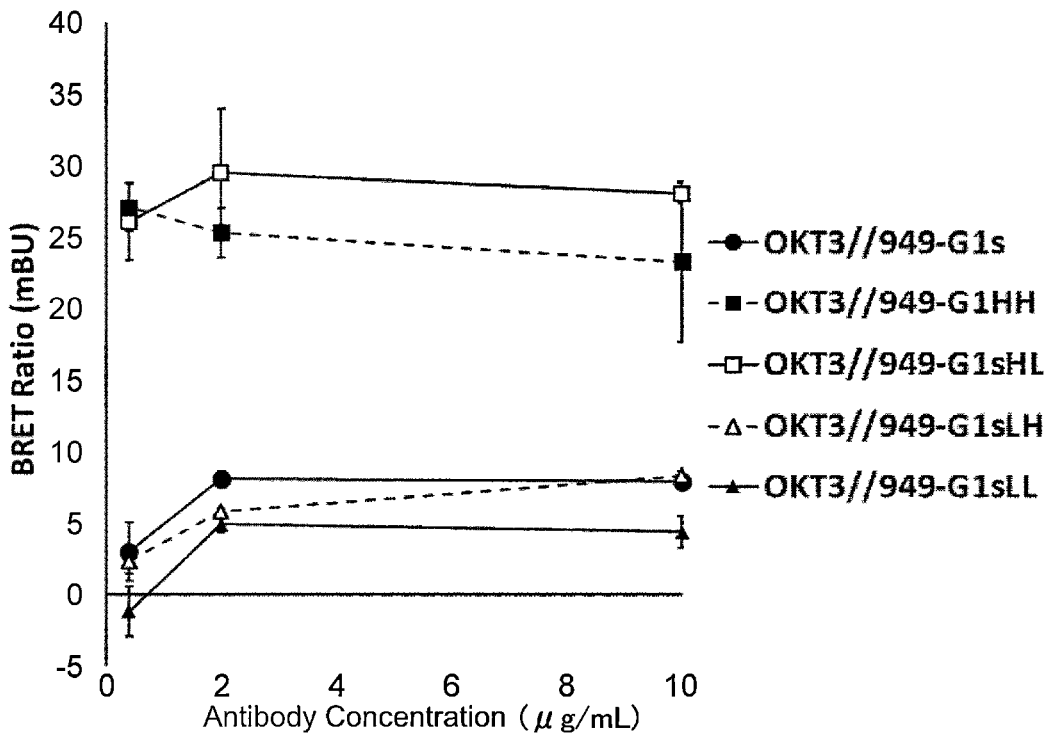
FIG. 32 shows the results of assaying the CD3- and/or PD1-mediated agonist activity of an anti-CD3×anti-PD1 bispecific antibody molecule (OKT3//949-G1silent) which is composed of an anti-CD3 antibody (OKT3) and an anti-PD1 antibody (949), and modified antibody molecules produced by linking the Fab-Fab of that antibody molecule via an additional disulfide bond (OKT3//949-G1silentHH, OKT3//949-G1silentHL, OKT3//949-G1silentLH, OKT3//949-G1silentLL), as described in Example 22-2.

As a result, in the bispecific antibodies consisting of an anti-CD3 antibody and an anti-PD1 antibody, modified molecules with an additional disulfide bond linking the Fab-Fab showed greatly varied CD3- and/or PD1-mediated signaling compared to bispecific antibodies lacking the additional disulfide bond as shown in FIG. 32.

Example 23 Assessment of Agonist Activity of CD28/CD3 Clamping Bispecific Antibodies Example 23-1 Real-Time Cell Growth Inhibition Assay (xCELLigence Assay)

Antibodies were prepared according to Examples 17 and 18. The antibodies used in this Example are shown in Table 61.

TABLE 61

| Antibody name | SEQ ID NO (Antibody 1): Heavy chain | SEQ ID NO (Antibody 1): Light chain | SEQ ID NO (Antibody 2): Heavy chain | SEQ ID NO (Antibody 2): Light chain | Molecular form |
|---|---|---|---|---|---|
| GPC3/attCE115 | 1181 | 1182 | 1183 | 1184 | Bispecific antibody |
| GPC3/attCE115_LL | 1185 | 1186 | 1187 | 1188 | Bispecific antibody |
| KLH/clamp CD3 | 1189 | 1190 | 1191 | 1192 | Bispecific antibody |
| GPC3/clamp CD3 | 1193 | 1194 | 1195 | 1196 | Bispecific antibody |
| CD28/clamp CD3 | 1197 | 1198 | 1199 | 1200 | Bispecific antibody |
| CD28/clamp CD3_HH | 1201 | 1202 | 1203 | 1204 | Bispecific antibody |

T cell-dependent cancer cell growth inhibitory effect of the antibodies was assessed using xCELLigence RTCA MP instrument (ACEA Biosciences). Cells of the human liver cancer cell line SK-Hep-1 forced to express Glypican-3 (GPC3) (SEQ ID NO: 1241) (SK-pcα31a) were used as target cells, and human peripheral blood mononuclear cells (PBMC: Cellular Technology Limited (CTL)) were used as effector cells. 1×10$^4$ cells of SK-pcα31a were seeded onto E-Plate 96 (ACEA Biosciences). On the next day were added 2×10$^5$ cells of PBMC and antibodies to make a final concentration of 0.001, 0.01, 0.1, 1, or 10 µg/mL. Cell growth was monitored every 15 minutes with xCELLigence, and culturing was continued for 72 hours. Cell growth inhibitory effect (CGI: %) was calculated by the following equation.

$$CGI(\%)=100-(CI_{Ab}\times 100/CI_{NoAb})$$

In the above equation, "$CI_{Ab}$" is the Cell index for a well at 72 hours after addition of an antibody (cell growth index measured with xCELLigence). Further, "$CI_{NoAb}$" is the Cell index for a well after 72 hours without antibody addition.

Example 23-2 Cytokine Production Assay

Cytokine production from T cells by antibodies was assessed as discussed below.

SK-pcα31a was used as the target cell and PBMC (Cellular Technology Limited (CTL)) was used as the effector cell. 1×10$^4$ cells of SK-pcα31a were seeded onto a 96-well plate. On the next day were added 2×10$^5$ cells of PBMC and antibodies to make a final concentration of 0.01, 0.1, 1, or 10 µg/mL. The culture supernatant was collected after 72 hours, and human IL-6 was measured using AlphaLISA (PerkinElmer).

Results

Figure 33A:
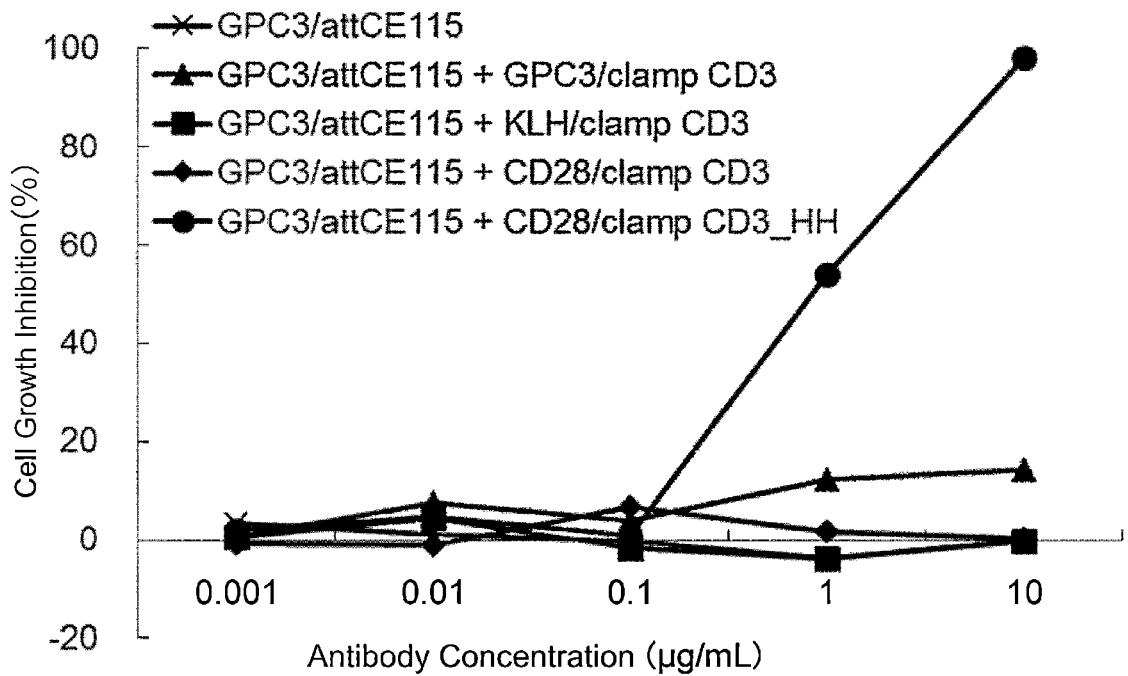
FIGS. 33A and B show the results of evaluating the T cell-dependent inhibitory effect on cancer cell growth when using a CD28/CD3 clamping bispecific antibody and a GPC3/binding-attenuated CD3 bispecific antibody in combination, as described in Example 23-1. When the above-mentioned CD28/CD3 clamping bispecific antibody and GPC3/binding-attenuated CD3 bispecific antibody are combined and allowed to act in the presence of target cells (GPC3-expressing cancer cells) and effector cells (T cells), the GPC3/binding-attenuated CD3 bispecific antibody brings the target cell and the effector cell close together, and the CD28/CD3 clamping bispecific antibody activates the effector cell.
Figure 33B:
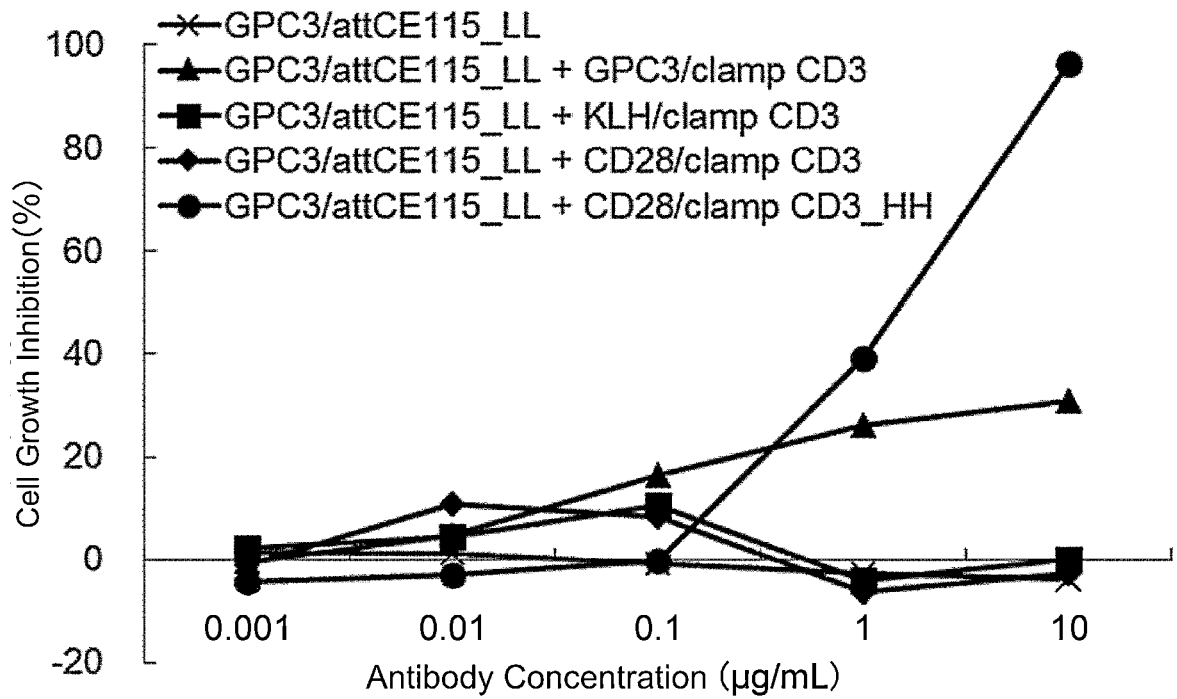
FIG. 33B shows the inhibitory effect on cancer cell growth when a modified antibody molecule produced by linking the Fab-Fab of the GPC3/binding-attenuated CD3 bispecific antibody via an additional disulfide bond (GPC3/attCE115_LL) was used as an antibody to target T cells to cancer cells, and a GPC3/CD3 clamping bispecific antibody molecule (GPC3/clamp CD3), a KLH/CD3 clamping bispecific antibody molecule (KLH/clamp CD3), a CD28/CD3 clamping bispecific antibody molecule (CD28/clamp CD3), or a modified antibody molecule produced by linking the Fab-Fab of that antibody molecule via an additional disulfide bond (CD28/clamp CD3_HH) was used as an antibody for activating T cells.
Figure 34A:
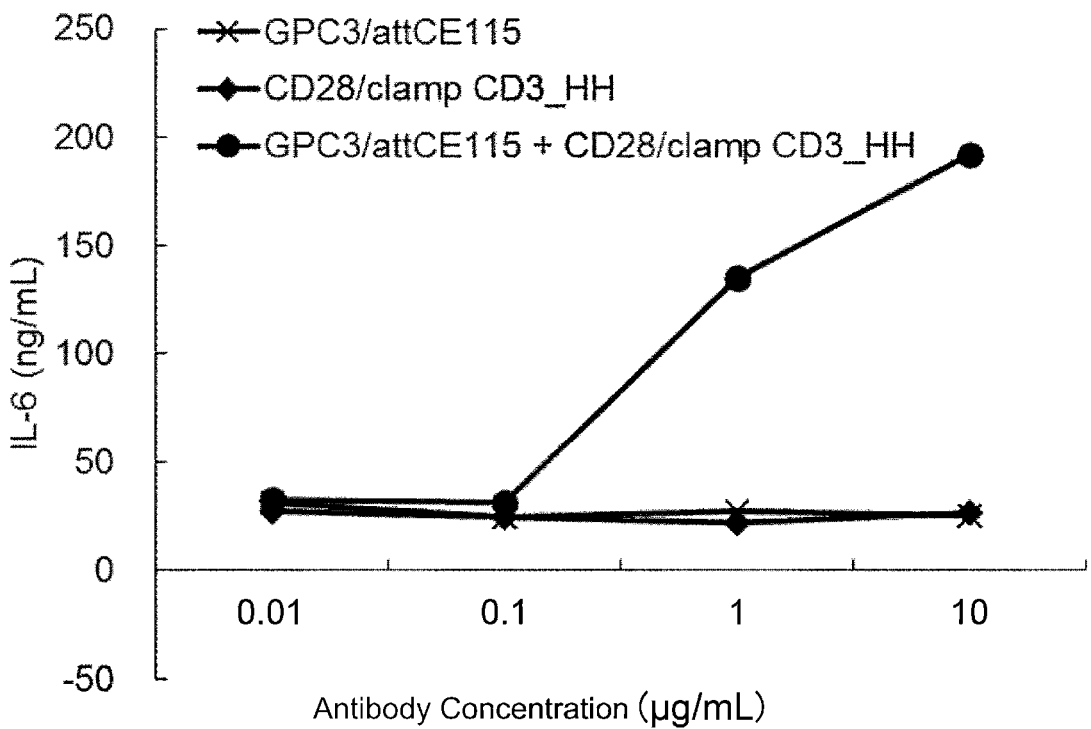
FIGS. 34A-C show the results of evaluating cytokine production from T cells when a CD28/CD3 clamping bispecific antibody and a GPC3/binding-attenuated CD3 bispecific antibody were used in combination as described in Example 23-2. When the above-mentioned CD28/CD3 clamping bispecific antibody and GPC3/binding-attenuated CD3 bispecific antibody are used in combination in the presence of target cells (GPC3-expressing cancer cells) and effector cells (T cells), the GPC3/binding-attenuated CD3 bispecific antibody brings the target cell and the effector cell close together, and the CD28/CD3 clamping bispecific antibody activates the effector cell.
Figure 34B:
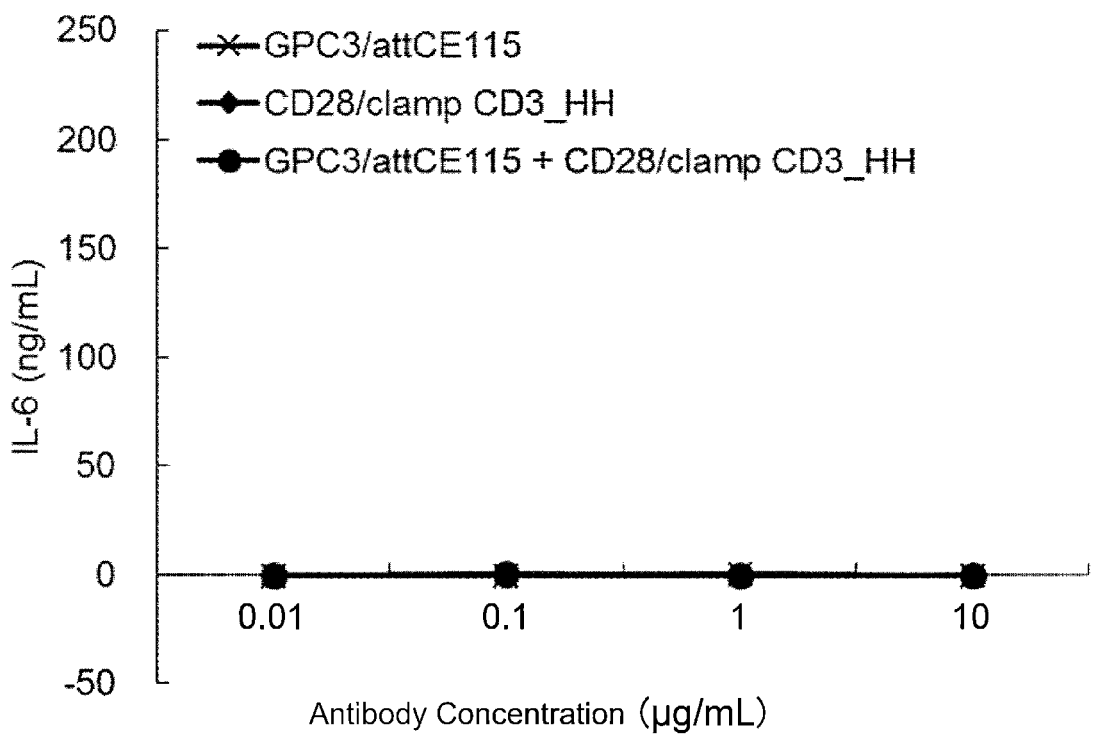
Figure 34C:
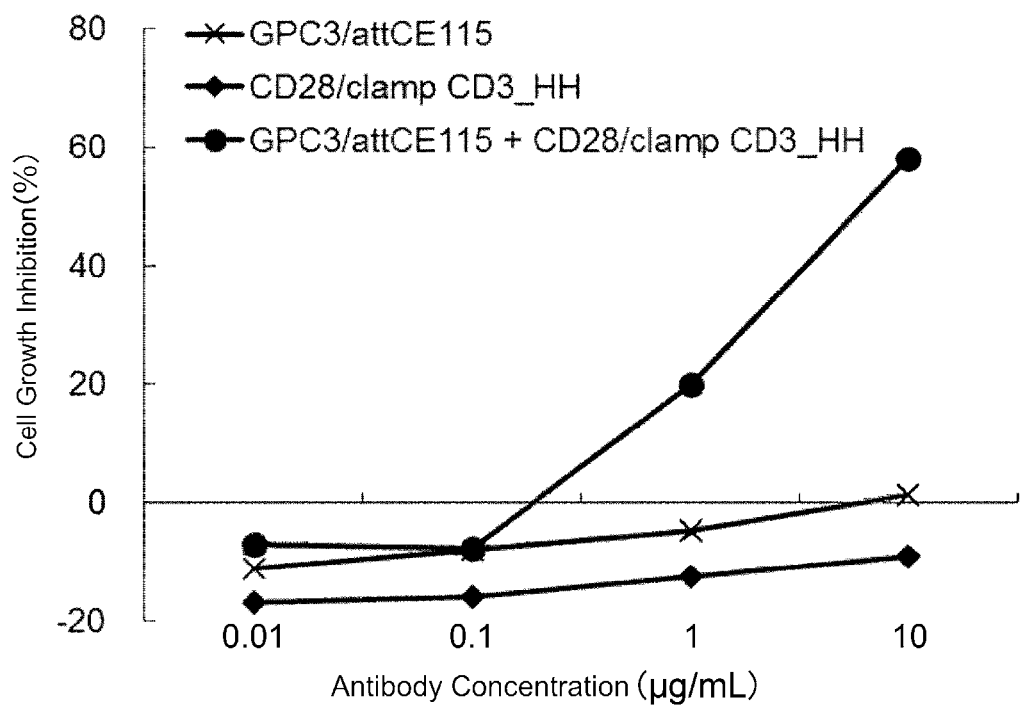
Figure 35A:
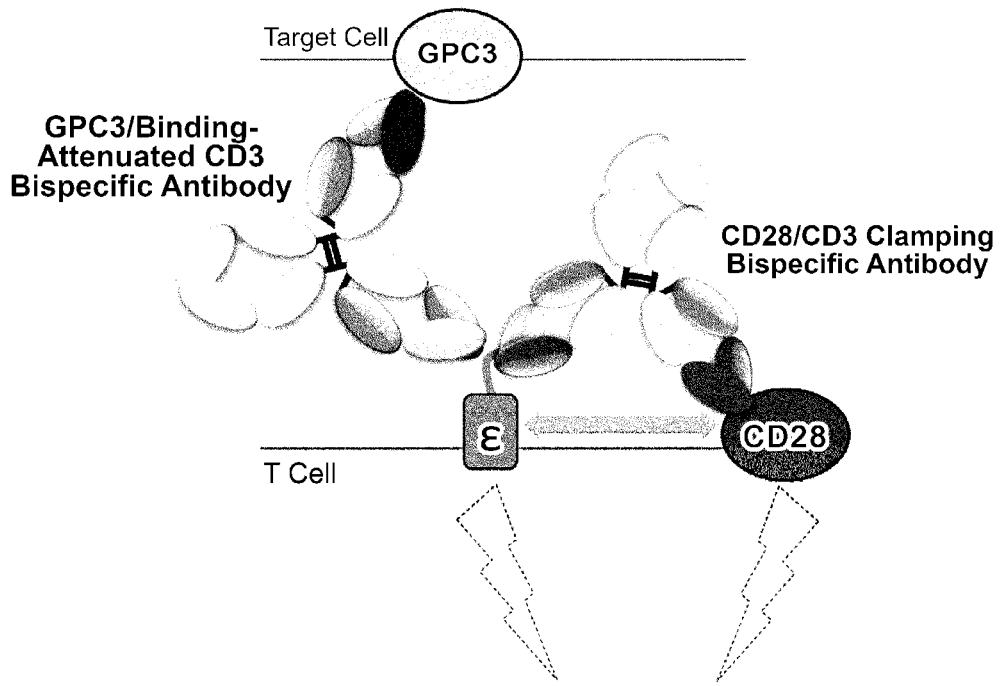
FIGS. 35A and B are schematic diagrams showing the mechanism of action of the T cell-dependent cancer cell growth inhibition when a CD28/CD3 clamping bispecific antibody and a GPC3/binding-attenuated CD3 bispecific antibody are used in combination, as described in Examples 23-1 ("ε" in the diagrams indicates CD3ε).
Figure 35B:
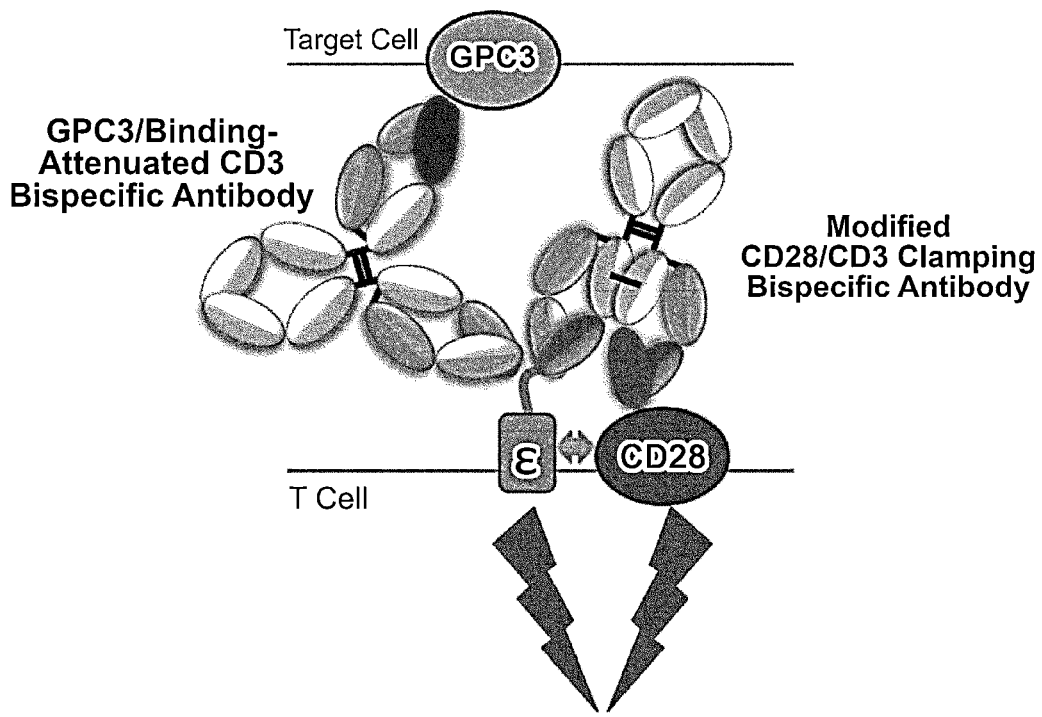
FIG. 35B shows the mechanism of action of the cancer cell growth inhibition when a modified antibody molecule which has been modified to introduce an additional disulfide bond into the Fab-Fab of a CD28/CD3 clamping bispecific antibody, and a GPC3/binding-attenuated CD3 bispecific antibody, are used in combination in the presence of target cells (GPC3-expressing cancer cells) and effector cells (T cells).
Figure 36A:
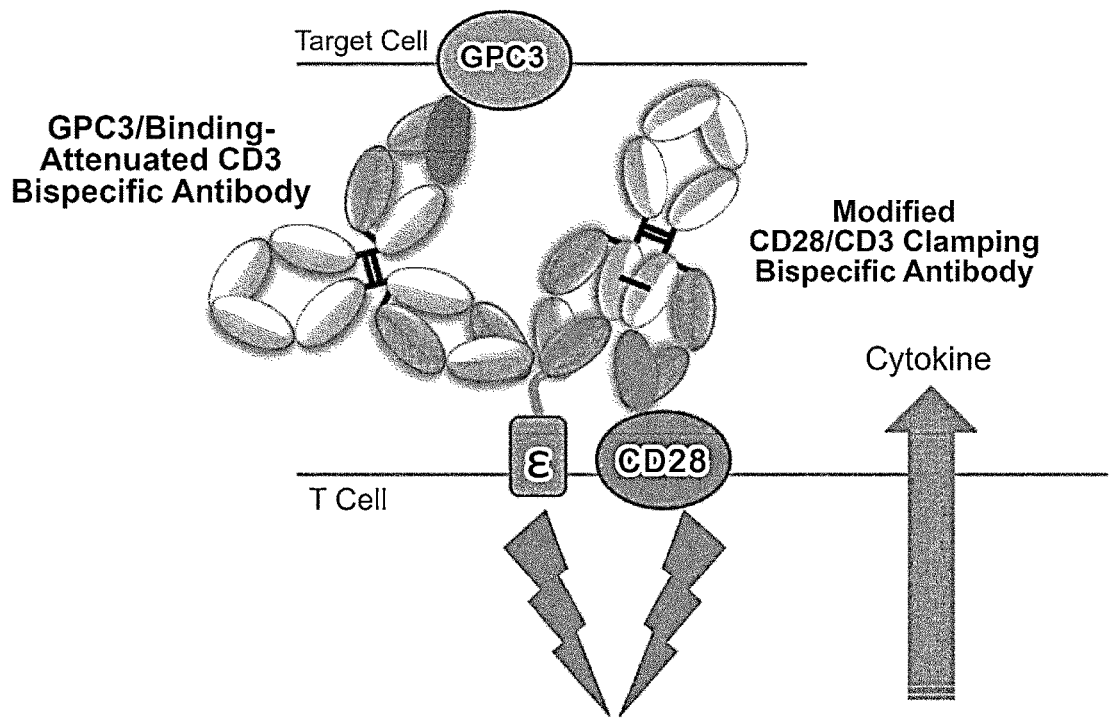
FIGS. 36A and B are schematic diagrams showing the mechanism of action of the cytokine production from T cells when a CD28/CD3 clamping bispecific antibody and a GPC3/binding-attenuated CD3 bispecific antibody are used in combination, as described in Examples 23-2 ("ε" in the diagrams indicates CD3E).
Figure 36B:
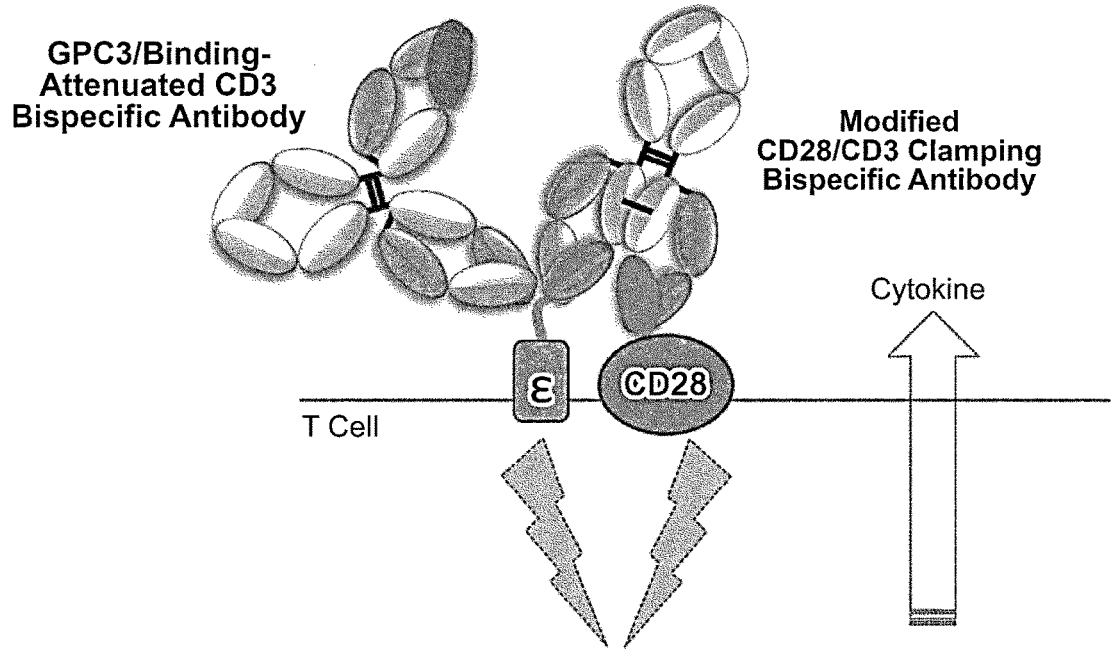
FIG. 36B shows the mechanism of action of the cytokine production when a modified antibody molecule which has been modified to introduce an additional disulfide bond into the Fab-Fab of a CD28/CD3 clamping bispecific antibody, and a GPC3/binding-attenuated CD3 bispecific antibody, are used in combination in the presence of effector cells (T cells) only.

Combined use of CD28/CD3 clamping bispecific antibody and GPC3/binding-attenuated CD3 bispecific antibody did not result in cell growth inhibitory effects. However, inhibitory effects on cancer cell growth were observed by applying modifications for introducing an additional disulfide bond between the Fab-Fab of the CD28/CD3 clamping bispecific antibody (FIGS. 33 and 35). Further, cytokine production was observed when a CD28/CD3 clamping bispecific antibody introduced with the above-noted modification and a GPC3/binding-attenuated CD3 bispecific antibody were cocultured with GPC3 expressing strain and PBMC; however, mere addition of a CD28/CD3 clamping bispecific antibody introduced with the above-noted modification and a GPC3/binding-attenuated CD3 bispecific antibody to PBMC did not result in cytokine production (FIGS. 34 and 36). Accordingly, it was suggested that the effect of the CD28/CD3 clamping bispecific antibody introduced with the above-noted modification and GPC3/binding-attenuated CD3 bispecific antibody on inhibiting cancer cell growth and inducing cytokine production in T cells depends on the expression of cancer antigen.

Example 24 Assessment of Agonist Activity of CD8/CD28 Bispecific Antibodies

Antibodies were prepared according to Examples 17 and 18. The antibodies used in this Example are shown in Table 62.

TABLE 62

| Antibody name | SEQ ID NO (Antibody 1): Heavy chain | SEQ ID NO (Antibody 1): Light chain | SEQ ID NO (Antibody 2): Heavy chain | SEQ ID NO (Antibody 2): Light chain | Molecular form |
|---|---|---|---|---|---|
| KLH-P587 | 1205 | 1206 | — | — | Monospecific antibody |
| CD8/CD28-P587 | 1207 | 1208 | 1209 | 1210 | Bispecific antibody |
| CD8/CD28-P587(HH) | 1211 | 1212 | 1213 | 1214 | Bispecific antibody |
| CD8/CD28-P587(LL) | 1219 | 1220 | 1221 | 1222 | Bispecific antibody |
| CD8/CD28-P587(HL) | 1223 | 1224 | 1225 | 1226 | Bispecific antibody |
| CD8/CD28-P587(LH) | 1227 | 1228 | 1229 | 1230 | Bispecific antibody |

Human peripheral blood mononuclear cells (PBMCs) isolated from healthy volunteer blood samples were used for assessing the prepared specimen. Heparin (0.5 mL) was mixed with 50 mL of blood and was further diluted with 50 mL PBS. Human PBMCs were isolated by the following two steps. In step 1, Leucosep (greiner bio-one) added with Ficoll-Paque PLUS (GE Healthcare) was centrifuged at 1000×g for 1 minute under room temperature, then blood diluted with PBS was added thereto and the mixture was centrifuged at 400×g for 30 minutes under room temperature. In step 2, the buffy coat was collected from the tube after centrifugation and then washed with 60 mL PBS (Wako). The isolated human PBMCs were adjusted to a cell density of $1\times10^7$/mL with a medium (5% human serum (SIGMA), 95% AIM-V (Thermo Fischer Scientific)). The resulting cell suspension was seeded onto the wells of a 24-well plate at 1 mL/well and the plate was incubated in a 5% $CO_2$ incubator at 37° C.

Two days later, the medium was removed from the seeded cells and the cells were washed with 500 μL PBS, and then collected using accutase (nacalai tesque). Next, the cells were adjusted to make a cell density of $1\times10^6$/mL with ViaFluor 405 (Biotium) solution diluted with PBS to make a final concentration of 2 μM, and then allowed to stand at 37° C. for 15 minutes. Subsequently, the cells were suspended again with a medium and then seeded onto the wells of a 96-well plate at $2\times10^5$ cells per well. Antibody solution was added thereto to make a final concentration of 0.1, 1, and 10 μg/mL, and the cells were cultured in a 5% $CO_2$ incubator for 4 days at 37° C.

Figure 37A:
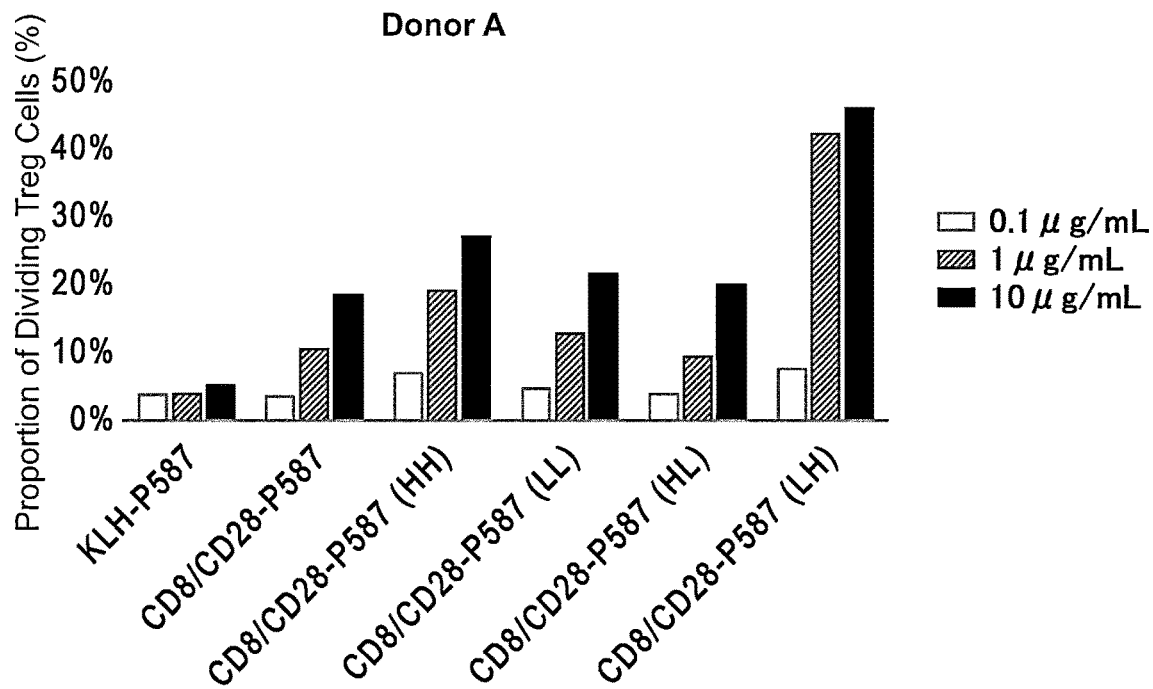
FIGS. 37A and B shows the results of assaying the agonist activity of a CD8/CD28 bispecific antibody molecule (CD8/CD28-P587), and modified antibody molecules produced by linking the Fab-Fab of that antibody via an additional disulfide bond (CD8/CD28-P587(HH), CD8/CD28-P587 (LL), CD8/CD28-P587(HL), CD8/CD28-P587(LH)) as described in Example 24. An anti-KLH antibody molecule (KLH-P587) was used as a negative control. The results obtained by using peripheral blood mononuclear cells (PBMC) from two different donors are shown (upper panel: donor A, lower panel: donor B).
Figure 37A:
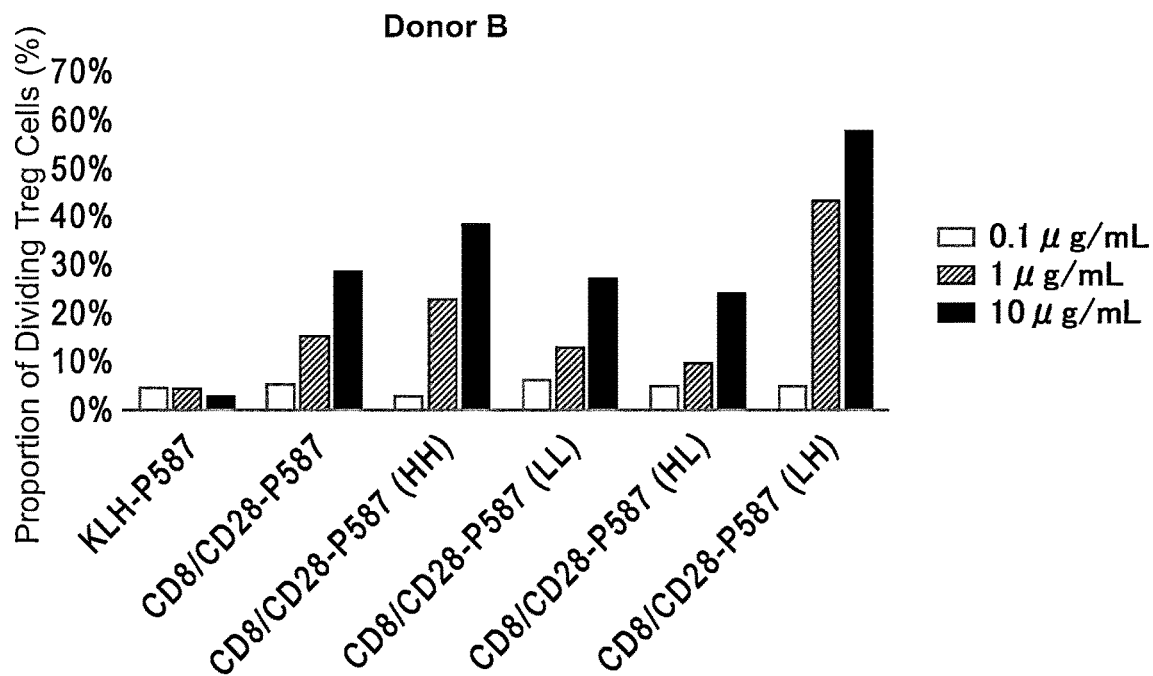
Figure 37B:
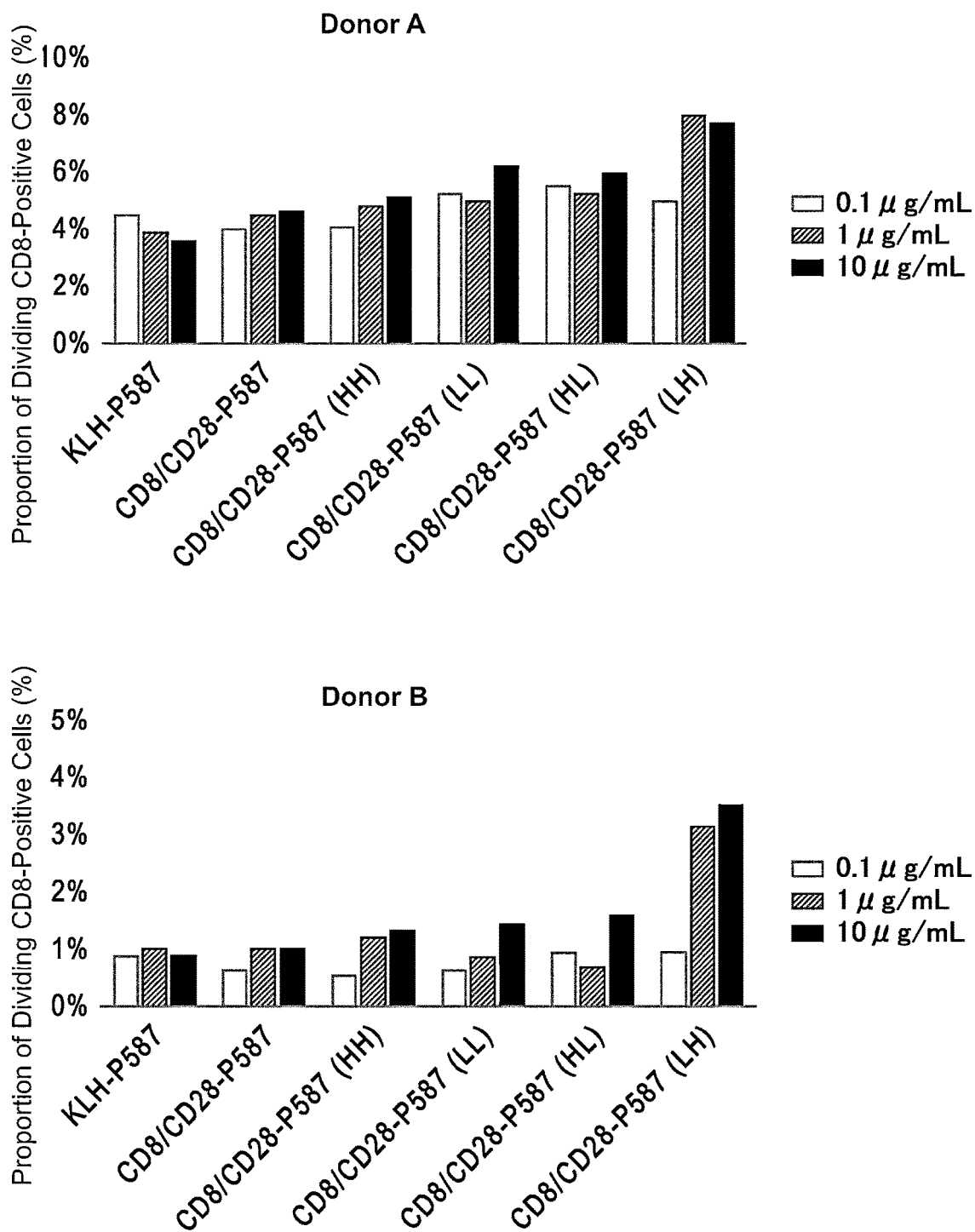
FIG. 37B shows the proportion of divided CD8α-positive T cells in PBMCs.

After the end of culturing, the percentage of grown cells was investigated using a flow cytometer (BD LSR-Fortessa™ X-20 (BD Biosciences)) (FCM). The percentage of grown cells was calculated from the percentage of reduced ViaFluor 405 fluorescence intensity. Fluorescently-labeled anti-CD8a antibody, anti-CD4 antibody, anti-Foxp3 antibody, and such were used for performing an analysis with CD8a positive T cells and regulatory T (Treg) cells. As a result, increase in activity was observed in some specimens as shown in FIG. 37.

Example 25 Assessment of Disulfide Bond Formation Between the Introduced Cysteines Modified antibodies were produced by introducing cysteine into the light and heavy chains of a humanized model antibody, and the formation of disulfide bond between the newly introduced cysteines was assessed. Assessment was carried out by incubating sample antibodies in 20 mM phosphate buffer (pH 7.0) with chymotrypsin and detecting the mass of peptides presumed to be produced from the amino acid sequence of each antibody, using LC/MS. Each antibody was prepared according to Examples 17 and 18. The antibodies used in this Example are shown in Table 63.

TABLE 63

| Antibody name | SEQ ID NO (Antibody 1): Heavy chain | SEQ ID NO (Antibody 1): Light chain | SEQ ID NO (Antibody 2): Heavy chain | SEQ ID NO (Antibody 2): Light chain | Molecular form |
|---|---|---|---|---|---|
| MRA-G1_LL | 1231 | 1232 | — | — | Monospecific antibody |
| MRA-G2_LL | 1233 | 1234 | — | — | Monospecific antibody |
| MRA-G4_LL | 1235 | 1236 | — | — | Monospecific antibody |
| MRA-G1T4.S191C | 1237 | 1238 | — | — | Monospecific antibody |
| MRA-G1T4.A162C | 1239 | 1240 | — | — | Monospecific antibody |

First, modified antibodies of different subclass (IgG1, IgG2, and IgG4) in which lysine at position 126 (Kabat numbering) of the light chain was substituted with cysteine were analyzed. As a result, in all of the antibodies analyzed, components that correspond to the theoretical mass of a peptide having a disulfide bond between the cysteines at position 126 were detected, as shown in Table 64. Further, this component disappeared when tris(2-carboxyethyl)phosphine, which has the reducing effect of disulfide bonds, was added to the IgG1 sample, suggesting that a disulfide bond is formed between the cysteines at position 126 in this peptide. At the same time, it was suggested that the difference in subclass does not affect this disulfide bond formation.

TABLE 64

| Peptide | Ion | Theoretical mass (Da) | Measured value (Da) IgG1 unreduced | Measured value (Da) IgG1 reduced | Measured value (Da) IgG2 unreduced | Measured value (Da) IgG4 unreduced |
|---|---|---|---|---|---|---|
| ((IFPPSDEQLC$^{126}$ | $[M+4H]^{4+}$ | 1460.2 | 1460.2 | n.d. | 1460.2 | 1460.2 |
| SGTASVVCL)- | $[M+5H]^{5+}$ | 1168.3 | 1168.4 | n.d. | 1168.4 | 1168.3 |
| (ACEVTHQGL))2 | $[M+6H]^{6+}$ | 973.8 | 973.8 | n.d. | 973.8 | 973.8 | n.d.: not detected

Next, analysis was performed on modified antibodies in which alanine at position 162 (EU numbering), or serine at position 191 (EU numbering) of IgG1 heavy chain was substituted with cysteine. As a result, components that correspond to the theoretical mass of a peptide having a disulfide bond between the introduced cysteines were detected, as shown respectively in Tables 65 and 66. Further, this component disappeared when tris(2-carboxyethyl)phosphine was added to the sample of a modified antibody introduced with position 191 cysteine (Table 66). From the above, it was suggested that a disulfide bond is formed between cysteines also introduced into the heavy chain.

TABLE 65

| Peptide | Ion | Theoretical mass (Da) | Measured value (Da) |
|---|---|---|---|
| $(NSGC^{162}L)_2$ | $[M + H]^+$ | 963.4 | 963.4 |
|  | $[M + 2H]^{2+}$ | 492.2 | 492.2 |

TABLE 66

| Peptide | ion | Theoretical mass (Da) | Measured value (Da) | |
|---|---|---|---|---|
|  |  |  | unreduced | reduced |
| $(SLSSVVTVPSC^{191}$ | $[M+2H]^{2+}$ | 1827.9 | 1827.9 | n.d. |
| $SLGTQTY)_2$ | $[M+3H]^{3+}$ | 1218.9 | 1218.9 | n.d. | n.d.: not detected

Although the foregoing invention has been described in some detail by way of illustration and example for purposes of clarity of understanding, the descriptions and examples should not be construed as limiting the scope of the invention. The disclosures of all patent and scientific literature cited herein are expressly incorporated in their entirety by reference.

INDUSTRIAL APPLICABILITY

In a non-limiting embodiment, the antigen-binding molecule of the present disclosure is useful in that it can hold multiple antigen molecules at spatially close positions, regulate interaction between multiple antigen molecules, and/or regulate activation of multiple antigen molecules which are activated by association with each other. In other embodiments, the antigen-binding molecule of the present disclosure is useful in that it has increased resistance to protease cleavage as compared to conventional antigen-binding molecules.

wherein the first antigen-binding domain and the second antigen-binding domain domains comprise a hinge region, wherein the first and second antigen-binding domains each comprise an antibody fragment which binds to a particular antigen, wherein the first and second antigen-binding domains are linked with each other by two or more bonds between amino acid residues in the first and second antigen binding domains, wherein at least one of the bonds is a disulfide bond, and wherein at least one amino acid residue from which the two or more bonds originate is present within a CH1 region and/or within a CL region of the antibody fragment of the first and second antigen-binding domains and at least one amino acid residue from which the bonds originate is present within a hinge region, wherein at least one of the bonds linking the two antigen-binding domains is formed by:

linking an amino acid residue in a CH1 region of the first antigen-binding domain with an amino acid residue in a CH1 region of the second antigen-binding domain, wherein at least one of the bonds linking the two antigen-binding domains is formed by linking any two amino acid residues selected from the group consisting of positions 119 to 123, 131 to 140, 148 to 150, 155 to 167, 174 to 178, 188 to 197, and 201 to 214, according to EU numbering, in a CH1 region of the first antigen-binding domain and a CH1 region of the second antigen binding domain, linking an amino acid residue in a CL region of the first antigen-binding domain with an amino acid residue in a CL region of the second antigen-binding domain, wherein at least one of the bonds linking the two antigen-binding domains is formed by linking any two amino acid residues selected from the group consisting of positions 108, 109, 112, 121, 123, 126, 128, 151, 152, 153, 156, 184, 186, 188, 189, 190, 195, 196, 200, 201, 202, 203, 208, 210, 211, 212, and 213, according to Kabat numbering, in a CL region of the first antigen-binding domain and a CL region of the second antigen binding domain, or linking an amino acid residue in a CH1 region of the first antigen-binding domain with an amino acid residue in a CL region of the second antigen-binding domain, wherein the amino acid residue in a CH1 region is selected from the group consisting of positions 188, 189, 190, 191, 192, 193, 194, 195, 196, and 197,

SEQUENCE LISTING (1241 sequences)

SEQ ID NO: 1 - protein, 447 aa, Artificial Sequence
  Hch
QVQLVESGGGVVQPGGSLRLSCAASGFTFSNAWMHWVRQAPGKGLEWVAQIKDKSQNYATYVAESVKGRFTISRADSKNSIYLQMNSLKTEDTAVYYCRYVHYAAGYGVDIWGQGTTVTVSSASTKGPSVFPLAPCSRSTSESTAALGCLVKDYFPEPVTVSWNSGALTSGVHTFPAVLQSSGLYSLSSVVTVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 2 - protein, 447 aa, Artificial Sequence
  Hch
QVQLVESGGGVVQPGGSLRLSCAASGFTFSNAWMHWVRQAPGKGLEWVAQIKDKSQNYATYVAESVKGRFTISRADSKNSIYLQMNSLKTEDTAVYYCRYVHYAAGYGVDIWGQGTTVTVSSASTKGPSVFPLAPCSRSTSESTAALGCLVKDYFPEPVTVSWNSGALTSGVHTFPAVLQSSGLYSLSSVVTVPSCSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 3 - protein, 447 aa, Artificial Sequence; identical to SEQ ID NO: 1
  Hch

SEQ ID NO: 4 - protein, 450 aa, Artificial Sequence
  Hch
QVQLVESGGGVVQPGGSLRLSCAASGFTFSNAWMHWVRQAPGKGLEWVAQIKDKSQNYATYVAESVKGRFTISRADSKNSIYLQMNSLKTEDTAVYYCRYVHYAAGYGVDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELRGGPKVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRKEMTKNQVSLTCLVKGFYPSDIAVEWESNGQPENNYKTTPPYLDSDGSFFLYSKLTVDKSRWQQGNVFSCSVMHEALHNHYTQKSLSLSP

SEQ ID NO: 5 - protein, 447 aa, Artificial Sequence
  Hch
QVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELRGGPKVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRKEMTKNQVSLTCLVKGFYPSDIAVEWESNGQPENNYKTTPPYLDSDGSFFLYSKLTVDKSRWQQGNVFSCSVMHEALHNHYTQKSLSLSP

SEQ ID NO: 6 - protein, 448 aa, Artificial Sequence
  Hch
QVQLVQSGAEVKKPGASVKVSCKASGYTFTSYYIHWVRQAPGQGLEWIGCIYPGNVNTNYNEKFKDRATLTVDTSISTAYMELSRLRSDDTAVYFCTRSHYGLDWNFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELRGGPKVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPYLDSDGSFFLYSKLTVDKSRWQQGNVFSCSVMHEALHNHYTQESLSLSP

SEQ ID NO: 7 - protein, 450 aa, Artificial Sequence
  Hch
QVQLVESGGGVVQPGGSLRLSCAASGFTFSNAWMHWVRQAPGKGLEWVAQIKDKSQNYATYVAESVKGRFTISRADSKNSIYLQMNSLKTEDTAVYYCRYVHYAAGYGVDIWGQGTTVTVSSASTKGPSVFPLAPSSKSTSGGTAALGCLVKDYFPEPVTVSWNSGALTSGVHTFPAVLQSSGLYSLSSVVTVPSCSLGTQTYICNVNHKPSNTKVDKKVEPKSCDKTHTCPPCPAPELRGGPKVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRKEMTKNQVSLTCLVKGFYPSDIAVEWESNGQPENNYKTTPPYLDSDGSFFLYSKLTVDKSRWQQGNVFSCSVMHEALHNHYTQKSLSLSP

SEQ ID NO: 8 - protein, 447 aa, Artificial Sequence
  Hch
QVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSASTKGPSVFPLAPSSKSTSGGTAALGCLVKDYFPEPVTVSWNSGALTSGVHTFPAVLQSSGLYSLSSVVTVPSCSLGTQTYICNVNHKPSNTKVDKKVEPKSCDKTHTCPPCPAPELRGGPKVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRKEMTKNQVSLTCLVKGFYPSDIAVEWESNGQPENNYKTTPPYLDSDGSFFLYSKLTVDKSRWQQGNVFSCSVMHEALHNHYTQKSLSLSP

SEQ ID NO: 9 - protein, 448 aa, Artificial Sequence
  Hch
QVQLVQSGAEVKKPGASVKVSCKASGYTFTSYYIHWVRQAPGQGLEWIGCIYPGNVNTNYNEKFKDRATLTVDTSISTAYMELSRLRSDDTAVYFCTRSHYGLDWNFDVWGQGTTVTVSSASTKGPSVFPLAPSSKSTSGGTAALGCLVKDYFPEPVTVSWNSGALTSGVHTFPAVLQSSGLYSLSSVVTVPSCSLGTQTYICNVNHKPSNTKVDKKVEPKSCDKTHTCPPCPAPELRGGPKVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPYLDSDGSFFLYSKLTVDKSRWQQGNVFSCSVMHEALHNHYTQESLSLSP

SEQ ID NO: 10 - protein, 219 aa, Artificial Sequence
  Lch
DIVMTQSPLSLPVTPGEPASISCRSSQPLVHSNRNTYLHWYQQKPGQAPRLLIYKVSNRFSGVPDRFSGSGSGTDFTLKISRVEAEDVGVYYCGQGTQVPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 11 - protein, 219 aa, Artificial Sequence
  Lch
DIVMTQSPLSLPVTPGEPASISCRSSQPLVHSNRNTYLHWYQQKPGQAPRLLIYKVSNRFSGVPDRFSGSGSGTDFTLKISRVEAEDVGVYYCGQGTQVPYTFGQGTKLEIKRTVAAPSVFIFPPSDEQLCSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12 - protein, 213 aa, Artificial Sequence
  Lch
QIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 13 - protein, 214 aa, Artificial Sequence
  Lch
DIQMTQSPSSLSASVGDRVTITCHASQNTYVWLNWYQQKPGKAPKLLIYKASNLHTGVPSRFSGSGSGTDFTLTISSLQPEDFATYYCQQGQTYPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14 - protein, 214 aa, Artificial Sequence
  Lch
DIQMTQSPSSLSASVGDRVTITCHASQNTYVWLNWYQQKPGKAPKLLIYKASNLHTGVPSRFSGSGSGTDFTLTISSLQPEDFATYYCQQGQTYPYTFGGGTKVEIKRTVAAPSVFIFPPSDEQLCSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15 - protein, 447 aa, Artificial Sequence
  Hch
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 16 - protein, 214 aa, Artificial Sequence [sequence omitted]

SEQ ID NO: 17 - protein, 119 aa, Artificial Sequence [sequence omitted]

SEQ ID NO: 18 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 19 - protein, 107 aa, Artificial Sequence [sequence omitted]

SEQ ID NO: 20 - protein, 107 aa, Artificial Sequence [sequence omitted]

SEQ ID NO: 21 - protein, 119 aa, Artificial Sequence
  VH
QVQLCESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 22 - protein, 119 aa, Artificial Sequence
  VH
QVQLQCSGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 23 - protein, 119 aa, Artificial Sequence
  VH
QVQLQECGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 24 - protein, 119 aa, Artificial Sequence
  VH
QVQLQESCPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 25 - protein, 119 aa, Artificial Sequence
  VH
QVQLQESGCGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 26 - protein, 119 aa, Artificial Sequence
  VH
QVQLQESGPCLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 27 - protein, 119 aa, Artificial Sequence
  VH
QVQLQESGPGCVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 28 - protein, 119 aa, Artificial Sequence
  VH
QVQLQESGPGLCRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 29 - protein, 119 aa, Artificial Sequence
  VH
QVQLQESGPGLVCPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 30 - protein, 119 aa, Artificial Sequence
  VH
QVQLQESGPGLVRCSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 31 - protein, 119 aa, Artificial Sequence
  VH
QVQLQESGPGLVRPCQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 32 - protein, 119 aa, Artificial Sequence
  VH
QVQLQESGPGLVRPSCTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 33 - protein, 119 aa, Artificial Sequence
  VH
QVQLQESGPGLVRPSQCLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 34 - protein, 119 aa, Artificial Sequence
  VH
QVQLQESGPGLVRPSQTCSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 35 - protein, 119 aa, Artificial Sequence
  VH
QVQLQESGPGLVRPSQTLCLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 36 - protein, 119 aa, Artificial Sequence
  VH
QVQLQESGPGLVRPSQTLSCTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 37 - protein, 119 aa, Artificial Sequence
  VH
QVQLQESGPGLVRPSQTLSLCCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 38 - protein, 119 aa, Artificial Sequence
  VH
QVQLQESGPGLVRPSQTLSLTCCVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 39 - protein, 119 aa, Artificial Sequence
  VH
QVQLQESGPGLVRPSQTLSLTCTVCGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 40 - protein, 119 aa, Artificial Sequence
  VH
QVQLQESGPGLVRPSQTLSLTCTVSCYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 41 - protein, 119 aa, Artificial Sequence
  VH
QVQLQESGPGLVRPSQTLSLTCTVSGYCITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 42 - protein, 119 aa, Artificial Sequence
  VH
QVQLQESGPGLVRPSQTLSLTCTVSGYSICSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 43 - protein, 119 aa, Artificial Sequence
  VH
QVQLQESGPGLVRPSQTLSLTCTVSGYSITSDHAWSWVRQPPGRGLEWIGYISYSGITTYNPSLKSCVTMLRDTSKNQFSLRLSSVTAADTAVYYCARSLARTTAMDYWGQGSLVTVSS

SEQ ID NO: 44 - protein, 119 aa, Artificial Sequence
  VH
QVQLQESGPGLVRPSQTLSLTCTVSGYSITSDHAWSWVRQPPGRGLEWIGYISYSGITTYNPSLKSRCTMLRDTSKNQFSLRLSSVTAADTAVYYCARSLARTTAMDYWGQGSLVTVSS

SEQ ID NO: 45 - protein, 119 aa, Artificial Sequence
  VH
QVQLQESGPGLVRPSQTLSLTCTVSGYSITSDHAWSWVRQPPGRGLEWIGYISYSGITTYNPSLKSRVCMLRDTSKNQFSLRLSSVTAADTAVYYCARSLARTTAMDYWGQGSLVTVSS

SEQ ID NO: 46 - protein, 119 aa, Artificial Sequence
  VH
QVQLQESGPGLVRPSQTLSLTCTVSGYSITSDHAWSWVRQPPGRGLEWIGYISYSGITTYNPSLKSRVTMCRDTSKNQFSLRLSSVTAADTAVYYCARSLARTTAMDYWGQGSLVTVSS

SEQ ID NO: 47 - protein, 119 aa, Artificial Sequence
  VH
QVQLQESGPGLVRPSQTLSLTCTVSGYSITSDHAWSWVRQPPGRGLEWIGYISYSGITTYNPSLKSRVTMLRCTSKNQFSLRLSSVTAADTAVYYCARSLARTTAMDYWGQGSLVTVSS

SEQ ID NO: 48 - protein, 119 aa, Artificial Sequence
  VH
QVQLQESGPGLVRPSQTLSLTCTVSGYSITSDHAWSWVRQPPGRGLEWIGYISYSGITTYNPSLKSRVTMLRDCSKNQFSLRLSSVTAADTAVYYCARSLARTTAMDYWGQGSLVTVSS

SEQ ID NO: 49 - protein, 119 aa, Artificial Sequence
  VH
QVQLQESGPGLVRPSQTLSLTCTVSGYSITSDHAWSWVRQPPGRGLEWIGYISYSGITTYNPSLKSRVTMLRDTCKNQFSLRLSSVTAADTAVYYCARSLARTTAMDYWGQGSLVTVSS

SEQ ID NO: 50 - protein, 119 aa, Artificial Sequence
  VH
QVQLQESGPGLVRPSQTLSLTCTVSGYSITSDHAWSWVRQPPGRGLEWIGYISYSGITTYNPSLKSRVTMLRDTSCNQFSLRLSSVTAADTAVYYCARSLARTTAMDYWGQGSLVTVSS

SEQ ID NO: 51 - protein, 119 aa, Artificial Sequence
  VH
QVQLQESGPGLVRPSQTLSLTCTVSGYSITSDHAWSWVRQPPGRGLEWIGYISYSGITTYNPSLKSRVTMLRDTSKCQFSLRLSSVTAADTAVYYCARSLARTTAMDYWGQGSLVTVSS

SEQ ID NO: 52 - protein, 119 aa, Artificial Sequence
  VH
QVQLQESGPGLVRPSQTLSLTCTVSGYSITSDHAWSWVRQPPGRGLEWIGYISYSGITTYNPSLKSRVTMLRDTSKNCFSLRLSSVTAADTAVYYCARSLARTTAMDYWGQGSLVTVSS

SEQ ID NO: 53 - protein, 119 aa, Artificial Sequence
  VH
QVQLQESGPGLVRPSQTLSLTCTVSGYSITSDHAWSWVRQPPGRGLEWIGYISYSGITTYNPSLKSRVTMLRDTSKNQFCLRLSSVTAADTAVYYCARSLARTTAMDYWGQGSLVTVSS

SEQ ID NO: 54 - protein, 119 aa, Artificial Sequence
  VH
QVQLQESGPGLVRPSQTLSLTCTVSGYSITSDHAWSWVRQPPGRGLEWIGYISYSGITTYNPSLKSRVTMLRDTSKNQFSCRLSSVTAADTAVYYCARSLARTTAMDYWGQGSLVTVSS

SEQ ID NO: 55 - protein, 119 aa, Artificial Sequence
  VH
QVQLQESGPGLVRPSQTLSLTCTVSGYSITSDHAWSWVRQPPGRGLEWIGYISYSGITTYNPSLKSRVTMLRDTSKNQFSLCLSSVTAADTAVYYCARSLARTTAMDYWGQGSLVTVSS

SEQ ID NO: 56 - protein, 119 aa, Artificial Sequence
  VH
QVQLQESGPGLVRPSQTLSLTCTVSGYSITSDHAWSWVRQPPGRGLEWIGYISYSGITTYNPSLKSRVTMLRDTSKNQFSLRCSSVTAADTAVYYCARSLARTTAMDYWGQGSLVTVSS

SEQ ID NO: 57 - protein, 119 aa, Artificial Sequence
  VH
QVQLQESGPGLVRPSQTLSLTCTVSGYSITSDHAWSWVRQPPGRGLEWIGYISYSGITTYNPSLKSRVTMLRDTSKNQFSLRLCSVTAADTAVYYCARSLARTTAMDYWGQGSLVTVSS

SEQ ID NO: 58 - protein, 119 aa, Artificial Sequence
  VH
QVQLQESGPGLVRPSQTLSLTCTVSGYSITSDHAWSWVRQPPGRGLEWIGYISYSGITTYNPSLKSRVTMLRDTSKNQFSLRLSCVTAADTAVYYCARSLARTTAMDYWGQGSLVTVSS

SEQ ID NO: 59 - protein, 119 aa, Artificial Sequence
  VH
QVQLQESGPGLVRPSQTLSLTCTVSGYSITSDHAWSWVRQPPGRGLEWIGYISYSGITTYNPSLKSRVTMLRDTSKNQFSLRLSSCTAADTAVYYCARSLARTTAMDYWGQGSLVTVSS

SEQ ID NO: 60 - protein, 119 aa, Artificial Sequence
  VH
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVCS

SEQ ID NO: 61 - protein, 119 aa, Artificial Sequence
  VH
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSC

SEQ ID NO: 62 - protein, 119 aa, Artificial Sequence
  VH
QVQLQESGPGLVRPSQTLSLTCTVSGYSITCDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 63 - protein, 119 aa, Artificial Sequence
  VH
QVQLQESGPGLVRPSQTLSLTCTVSGYSITSDHACSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 64 - protein, 119 aa, Artificial Sequence
  VH
QVQLQESGPGLVRPSQTLSLTCTVSGYSITSDHAWCWVRQPPGRGLEWIGYISYSGITTYNPSLKSRVTMLRDTSKNQFSLRLSSVTAADTAVYYCARSLARTTAMDYWGQGSLVTVSS

SEQ ID NO: 65 - protein, 119 aa, Artificial Sequence
  VH
QVQLQESGPGLVRPSQTLSLTCTVSGYSITSDHAWSWVRQPPGRGLEWIGCISYSGITTYNPSLKSRVTMLRDTSKNQFSLRLSSVTAADTAVYYCARSLARTTAMDYWGQGSLVTVSS

SEQ ID NO: 66 - protein, 119 aa, Artificial Sequence
  VH
QVQLQESGPGLVRPSQTLSLTCTVSGYSITSDHAWSWVRQPPGRGLEWIGYCSYSGITTYNPSLKSRVTMLRDTSKNQFSLRLSSVTAADTAVYYCARSLARTTAMDYWGQGSLVTVSS

SEQ ID NO: 67 - protein, 119 aa, Artificial Sequence
  VH
QVQLQESGPGLVRPSQTLSLTCTVSGYSITSDHAWSWVRQPPGRGLEWIGYICYSGITTYNPSLKSRVTMLRDTSKNQFSLRLSSVTAADTAVYYCARSLARTTAMDYWGQGSLVTVSS

SEQ ID NO: 68 - protein, 119 aa, Artificial Sequence
  VH
QVQLQESGPGLVRPSQTLSLTCTVSGYSITSDHAWSWVRQPPGRGLEWIGYISYSGITTYNPCLKSRVTMLRDTSKNQFSLRLSSVTAADTAVYYCARSLARTTAMDYWGQGSLVTVSS

SEQ ID NO: 69 - protein, 119 aa, Artificial Sequence
  VH
QVQLQESGPGLVRPSQTLSLTCTVSGYSITSDHAWSWVRQPPGRGLEWIGYISYSGITTYNPSCKSRVTMLRDTSKNQFSLRLSSVTAADTAVYYCARSLARTTAMDYWGQGSLVTVSS

SEQ ID NO: 70 - protein, 119 aa, Artificial Sequence
  VH
QVQLQESGPGLVRPSQTLSLTCTVSGYSITSDHAWSWVRQPPGRGLEWIGYISYSGITTYNPSLCSRVTMLRDTSKNQFSLRLSSVTAADTAVYYCARSLARTTAMDYWGQGSLVTVSS

SEQ ID NO: 71 - protein, 119 aa, Artificial Sequence
  VH
QVQLQESGPGLVRPSQTLSLTCTVSGYSITSDHAWSWVRQPPGRGLEWIGYISYSGITTYNPSLKCRVTMLRDTSKNQFSLRLSSVTAADTAVYYCARSLARTTAMDYWGQGSLVTVSS

SEQ ID NO: 72 - protein, 119 aa, Artificial Sequence
  VH
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMCYWGQGSLVTVSS

SEQ ID NO: 73 - protein, 119 aa, Artificial Sequence
  VH
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDCWGQGSLVTVSS

SEQ ID NO: 74 - protein, 328 aa, Artificial Sequence
  CH
CSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 75 - protein, 328 aa, Artificial Sequence
  CH
ACTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 76 - protein, 328 aa, Artificial Sequence
  CH
ASCKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 77 - protein, 328 aa, Artificial Sequence
  CH
ASTCGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 78 - protein, 328 aa, Artificial Sequence
  CH
ASTKCPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 79 - protein, 328 aa, Artificial Sequence
  CH
ASTKGCSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 80 - protein, 328 aa, Artificial Sequence
  CH
ASTKGPCVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 81 - protein, 328 aa, Artificial Sequence
  CH
ASTKGPSCFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 82 - protein, 328 aa, Artificial Sequence
  CH
ASTKGPSVCPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 83 - protein, 328 aa, Artificial Sequence
  CH
ASTKGPSVFCLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 84 - protein, 328 aa, Artificial Sequence
  CH
ASTKGPSVFPLAPCSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 85 - protein, 328 aa, Artificial Sequence
  CH
ASTKGPSVFPLAPSCKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 86 - protein, 328 aa, Artificial Sequence
  CH
ASTKGPSVFPLAPSSCSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 87 - protein, 328 aa, Artificial Sequence
  CH
ASTKGPSVFPLAPSSKCTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 88 - protein, 328 aa, Artificial Sequence
  CH
ASTKGPSVFPLAPSSKSCSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 89 - protein, 328 aa, Artificial Sequence
  CH
ASTKGPSVFPLAPSSKSTCGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 90 - protein, 328 aa, Artificial Sequence
  CH
ASTKGPSVFPLAPSSKSTSCGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 91 - protein, 328 aa, Artificial Sequence
  CH
ASTKGPSVFPLAPSSKSTSGCTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 92 - protein, 328 aa, Artificial Sequence
  CH
ASTKGPSVFPLAPSSKSTSGGCAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 93 - protein, 328 aa, Artificial Sequence
  CH
ASTKGPSVFPLAPSSKSTSGGTCALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 94 - protein, 328 aa, Artificial Sequence
  CH
ASTKGPSVFPLAPSSKSTSGGTACLGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 95 - protein, 328 aa, Artificial Sequence
  CH
ASTKGPSVFPLAPSSKSTSGGTAALGCLVKCYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 96 - protein, 328 aa, Artificial Sequence
  CH
ASTKGPSVFPLAPSSKSTSGGTAALGCLVKDCFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 97 - protein, 328 aa, Artificial Sequence
  CH
ASTKGPSVFPLAPSSKSTSGGTAALGCLVKDYCPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 98 - protein, 328 aa, Artificial Sequence
  CH
ASTKGPSVFPLAPSSKSTSGGTAALGCLVKDYFCEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 99 - protein, 328 aa, Artificial Sequence
  CH
ASTKGPSVFPLAPSSKSTSGGTAALGCLVKDYFPCPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 100 - protein, 328 aa, Artificial Sequence
  CH
ASTKGPSVFPLAPSSKSTSGGTAALGCLVKDYFPECVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 101 - protein, 328 aa, Artificial Sequence
  CH
ASTKGPSVFPLAPSSKSTSGGTAALGCLVKDYFPEPCTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 102 - protein, 328 aa, Artificial Sequence
  CH
ASTKGPSVFPLAPSSKSTSGGTAALGCLVKDYFPEPVCVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 103 - protein, 328 aa, Artificial Sequence
  CH
ASTKGPSVFPLAPSSKSTSGGTAALGCLVKDYFPEPVTCSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 104 - protein, 328 aa, Artificial Sequence
  CH
ASTKGPSVFPLAPSSKSTSGGTAALGCLVKDYFPEPVTVCWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 105 - protein, 328 aa, Artificial Sequence
  CH
ASTKGPSVFPLAPSSKSTSGGTAALGCLVKDYFPEPVTVSCNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 106 - protein, 328 aa, Artificial Sequence
  CH
ASTKGPSVFPLAPSSKSTSGGTAALGCLVKDYFPEPVTVSWCSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 107 - protein, 328 aa, Artificial Sequence
  CH
ASTKGPSVFPLAPSSKSTSGGTAALGCLVKDYFPEPVTVSWNCGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 108 - protein, 328 aa, Artificial Sequence
  CH
ASTKGPSVFPLAPSSKSTSGGTAALGCLVKDYFPEPVTVSWNSCALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 109 - protein, 328 aa, Artificial Sequence
  CH
ASTKGPSVFPLAPSSKSTSGGTAALGCLVKDYFPEPVTVSWNSGCLTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 110 - protein, 328 aa, Artificial Sequence
  CH
ASTKGPSVFPLAPSSKSTSGGTAALGCLVKDYFPEPVTVSWNSGACTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 111 - protein, 328 aa, Artificial Sequence
  CH
ASTKGPSVFPLAPSSKSTSGGTAALGCLVKDYFPEPVTVSWNSGALCSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 112 - protein, 328 aa, Artificial Sequence
  CH
ASTKGPSVFPLAPSSKSTSGGTAALGCLVKDYFPEPVTVSWNSGALTCGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 113 - protein, 328 aa, Artificial Sequence
  CH
ASTKGPSVFPLAPSSKSTSGGTAALGCLVKDYFPEPVTVSWNSGALTSCVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 114 - protein, 328 aa, Artificial Sequence
  CH
ASTKGPSVFPLAPSSKSTSGGTAALGCLVKDYFPEPVTVSWNSGALTSGCHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 115 - protein, 328 aa, Artificial Sequence
  CH
ASTKGPSVFPLAPSSKSTSGGTAALGCLVKDYFPEPVTVSWNSGALTSGVHTFPACLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 116 - protein, 328 aa, Artificial Sequence
  CH
ASTKGPSVFPLAPSSKSTSGGTAALGCLVKDYFPEPVTVSWNSGALTSGVHTFPAVCQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 117 - protein, 328 aa, Artificial Sequence
  CH
ASTKGPSVFPLAPSSKSTSGGTAALGCLVKDYFPEPVTVSWNSGALTSGVHTFPAVLCSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 118 - protein, 328 aa, Artificial Sequence
  CH
ASTKGPSVFPLAPSSKSTSGGTAALGCLVKDYFPEPVTVSWNSGALTSGVHTFPAVLQCSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 119 - protein, 328 aa, Artificial Sequence
  CH
ASTKGPSVFPLAPSSKSTSGGTAALGCLVKDYFPEPVTVSWNSGALTSGVHTFPAVLQSCGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 120 - protein, 328 aa, Artificial Sequence
  CH
ASTKGPSVFPLAPSSKSTSGGTAALGCLVKDYFPEPVTVSWNSGALTSGVHTFPAVLQSSCLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 121 - protein, 328 aa, Artificial Sequence
  CH
ASTKGPSVFPLAPSSKSTSGGTAALGCLVKDYFPEPVTVSWNSGALTSGVHTFPAVLQSSGCYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 122 - protein, 328 aa, Artificial Sequence
  CH
ASTKGPSVFPLAPSSKSTSGGTAALGCLVKDYFPEPVTVSWNSGALTSGVHTFPAVLQSSGLCSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 123 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVCTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 124 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVCVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 125 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTCPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 126 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVCSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 127 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPCSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 128 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSCSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 129 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSCLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 130 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSCGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 131 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLCTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 132 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGCQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 133 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTCTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 134 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQCYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 135 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTCICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 136 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYCCNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 137 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICCVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 138 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNCNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 139 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVCHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 140 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNCKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 141 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHCPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 142 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKCSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 143 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPCNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 144 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSCTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 145 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNCKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 146 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTCVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 147 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKCDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 148 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVCKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 149 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDCRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 150 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKCVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 151 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRCEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 152 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVCPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 153 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVECKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 154 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPCSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 155 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKCCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 156 - protein, 107 aa, Artificial Sequence
  VL
DIQMCQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 157 - protein, 107 aa, Artificial Sequence
  VL
DIQMTCSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 158 - protein, 107 aa, Artificial Sequence
  VL
DIQMTQCPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 159 - protein, 107 aa, Artificial Sequence
  VL
DIQMTQSCSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 160 - protein, 107 aa, Artificial Sequence
  VL
DIQMTQSPCSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 161 - protein, 107 aa, Artificial Sequence
  VL
DIQMTQSPSCLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 162 - protein, 107 aa, Artificial Sequence
  VL
DIQMTQSPSSCSASVGDRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 163 - protein, 107 aa, Artificial Sequence
  VL
DIQMTQSPSSLCASVGDRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 164 - protein, 107 aa, Artificial Sequence
  VL
DIQMTQSPSSLSCSVGDRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 165 - protein, 107 aa, Artificial Sequence
  VL
DIQMTQSPSSLSACVGDRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 166 - protein, 107 aa, Artificial Sequence
  VL
DIQMTQSPSSLSASCGDRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 167 - protein, 107 aa, Artificial Sequence
  VL
DIQMTQSPSSLSASVCDRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 168 - protein, 107 aa, Artificial Sequence
  VL
DIQMTQSPSSLSASVGCRVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 169 - protein, 107 aa, Artificial Sequence
  VL
DIQMTQSPSSLSASVGDCVTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 170 - protein, 107 aa, Artificial Sequence
  VL
DIQMTQSPSSLSASVGDRCTITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 171 - protein, 107 aa, Artificial Sequence
  VL
DIQMTQSPSSLSASVGDRVCITCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 172 - protein, 107 aa, Artificial Sequence
  VL
DIQMTQSPSSLSASVGDRVTCTCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 173 - protein, 107 aa, Artificial Sequence
  VL
DIQMTQSPSSLSASVGDRVTICCRASQDISSYLNWYQQKPGKAPKLLIYYTSRLHSGVPSRFSGSGSGTDFTFTISSLQPEDIATYYCQQGNTLPYTFGQGTKVEIK

SEQ ID NO: 174 - protein, 107 aa, Artificial Sequence
  VL
DIQMTQSPSSLSASVGDRVTITCRASQDISSYLNWYQQKPGKAPKLLIYYTSRLHSCVPSRFSGSGSGTDFTFTISSLQPEDIATYYCQQGNTLPYTFGQGTKVEIK

SEQ ID NO: 175 - protein, 107 aa, Artificial Sequence
  VL
DIQMTQSPSSLSASVGDRVTITCRASQDISSYLNWYQQKPGKAPKLLIYYTSRLHSGCPSRFSGSGSGTDFTFTISSLQPEDIATYYCQQGNTLPYTFGQGTKVEIK

SEQ ID NO: 176 - protein, 107 aa, Artificial Sequence
  VL
DIQMTQSPSSLSASVGDRVTITCRASQDISSYLNWYQQKPGKAPKLLIYYTSRLHSGVCSRFSGSGSGTDFTFTISSLQPEDIATYYCQQGNTLPYTFGQGTKVEIK

SEQ ID NO: 177 - protein, 107 aa, Artificial Sequence
  VL
DIQMTQSPSSLSASVGDRVTITCRASQDISSYLNWYQQKPGKAPKLLIYYTSRLHSGVPCRFSGSGSGTDFTFTISSLQPEDIATYYCQQGNTLPYTFGQGTKVEIK

SEQ ID NO: 178 - protein, 107 aa, Artificial Sequence
  VL
DIQMTQSPSSLSASVGDRVTITCRASQDISSYLNWYQQKPGKAPKLLIYYTSRLHSGVPSCFSGSGSGTDFTFTISSLQPEDIATYYCQQGNTLPYTFGQGTKVEIK

SEQ ID NO: 179 - protein, 107 aa, Artificial Sequence
  VL
DIQMTQSPSSLSASVGDRVTITCRASQDISSYLNWYQQKPGKAPKLLIYYTSRLHSGVPSRCSGSGSGTDFTFTISSLQPEDIATYYCQQGNTLPYTFGQGTKVEIK

SEQ ID NO: 180 - protein, 107 aa, Artificial Sequence
  VL
DIQMTQSPSSLSASVGDRVTITCRASQDISSYLNWYQQKPGKAPKLLIYYTSRLHSGVPSRFCGSGSGTDFTFTISSLQPEDIATYYCQQGNTLPYTFGQGTKVEIK

SEQ ID NO: 181 - protein, 107 aa, Artificial Sequence
  VL
DIQMTQSPSSLSASVGDRVTITCRASQDISSYLNWYQQKPGKAPKLLIYYTSRLHSGVPSRFSGCGSGTDFTFTISSLQPEDIATYYCQQGNTLPYTFGQGTKVEIK

SEQ ID NO: 182 - protein, 107 aa, Artificial Sequence
  VL
DIQMTQSPSSLSASVGDRVTITCRASQDISSYLNWYQQKPGKAPKLLIYYTSRLHSGVPSRFSGSGCGTDFTFTISSLQPEDIATYYCQQGNTLPYTFGQGTKVEIK

SEQ ID NO: 183 - protein, 107 aa, Artificial Sequence
  VL
DIQMTQSPSSLSASVGDRVTITCRASQDISSYLNWYQQKPGKAPKLLIYYTSRLHSGVPSRFSGSGSCTDFTFTISSLQPEDIATYYCQQGNTLPYTFGQGTKVEIK

SEQ ID NO: 184 - protein, 107 aa, Artificial Sequence
  VL
DIQMTQSPSSLSASVGDRVTITCRASQDISSYLNWYQQKPGKAPKLLIYYTSRLHSGVPSRFSGSGSGCDFTFTISSLQPEDIATYYCQQGNTLPYTFGQGTKVEIK

SEQ ID NO: 185 - protein, 107 aa, Artificial Sequence
  VL
DIQMTQSPSSLSASVGDRVTITCRASQDISSYLNWYQQKPGKAPKLLIYYTSRLHSGVPSRFSGSGSGTCFTFTISSLQPEDIATYYCQQGNTLPYTFGQGTKVEIK

SEQ ID NO: 186 - protein, 107 aa, Artificial Sequence
  VL
DIQMTQSPSSLSASVGDRVTITCRASQDISSYLNWYQQKPGKAPKLLIYYTSRLHSGVPSRFSGSGSGTDFCFTISSLQPEDIATYYCQQGNTLPYTFGQGTKVEIK

SEQ ID NO: 187 - protein, 107 aa, Artificial Sequence
  VL
DIQMTQSPSSLSASVGDRVTITCRASQDISSYLNWYQQKPGKAPKLLIYYTSRLHSGVPSRFSGSGSGTDFTCTISSLQPEDIATYYCQQGNTLPYTFGQGTKVEIK

SEQ ID NO: 188 - protein, 107 aa, Artificial Sequence
  VL
DIQMTQSPSSLSASVGDRVTITCRASQDISSYLNWYQQKPGKAPKLLIYYTSRLHSGVPSRFSGSGSGTDFTFCISSLQPEDIATYYCQQGNTLPYTFGQGTKVEIK

SEQ ID NO: 189 - protein, 107 aa, Artificial Sequence
  VL
DIQMTQSPSSLSASVGDRVTITCRASQDISSYLNWYQQKPGKAPKLLIYYTSRLHSGVPSRFSGSGSGTDFTFTCSSLQPEDIATYYCQQGNTLPYTFGQGTKVEIK

SEQ ID NO: 190 - protein, 107 aa, Artificial Sequence
  VL
DIQMTQSPSSLSASVGDRVTITCRASQDISSYLNWYQQKPGKAPKLLIYYTSRLHSGVPSRFSGSGSGTDFTFTICSLQPEDIATYYCQQGNTLPYTFGQGTKVEIK

SEQ ID NO: 191 - protein, 107 aa, Artificial Sequence
  VL
DIQMTQSPSSLSASVGDRVTITCRASQDISSYLNWYQQKPGKAPKLLIYYTSRLHSGVPSRFSGSGSGTDFTFTISCLQPEDIATYYCQQGNTLPYTFGQGTKVEIK

SEQ ID NO: 192 - protein, 107 aa, Artificial Sequence
  VL
DIQMTQSPSSLSASVGDRVTITCRASQDISSYLNWYQQKPGKAPKLLIYYTSRLHSGVPSRFSGSGSGTDFTFTISSCQPEDIATYYCQQGNTLPYTFGQGTKVEIK

SEQ ID NO: 193 - protein, 107 aa, Artificial Sequence
  VL
DIQMTQSPSSLSASVGDRVTITCRASQDISSYLNWYQQKPGKAPKLLIYYTSRLHSGVPSRFSGSGSGTDFTFTISSLCPEDIATYYCQQGNTLPYTFGQGTKVEIK

SEQ ID NO: 194 - protein, 107 aa, Artificial Sequence
  VL
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTCGQGTKVEIK

SEQ ID NO: 195 - protein, 107 aa, Artificial Sequence
  VL
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFCQGTKVEIK

SEQ ID NO: 196 - protein, 107 aa, Artificial Sequence
  VL
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGCGTKVEIK

SEQ ID NO: 197 - protein, 107 aa, Artificial Sequence
  VL
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQCTKVEIK

SEQ ID NO: 198 - protein, 107 aa, Artificial Sequence
  VL
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGCKVEIK

SEQ ID NO: 199 - protein, 107 aa, Artificial Sequence
  VL
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTCVEIK

SEQ ID NO: 200 - protein, 107 aa, Artificial Sequence
  VL
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKCEIK

SEQ ID NO: 201 - protein, 107 aa, Artificial Sequence
  VL
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVCIK

SEQ ID NO: 202 - protein, 107 aa, Artificial Sequence
  VL
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVECK

SEQ ID NO: 203 - protein, 107 aa, Artificial Sequence
  VL
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIC

SEQ ID NO: 204 - protein, 107 aa, Artificial Sequence
  VL
DIQMTQSPSSLSASVGDRVTITCRCSQDISSYLNWYQQKPGKAPKLLIYYTSRLHSGVPSRFSGSGSGTDFTFTISSLQPEDIATYYCQQGNTLPYTFGQGTKVEIK

SEQ ID NO: 205 - protein, 107 aa, Artificial Sequence
  VL
DIQMTQSPSSLSASVGDRVTITCRACQDISSYLNWYQQKPGKAPKLLIYYTSRLHSGVPSRFSGSGSGTDFTFTISSLQPEDIATYYCQQGNTLPYTFGQGTKVEIK

SEQ ID NO: 206 - protein, 107 aa, Artificial Sequence
  VL
DIQMTQSPSSLSASVGDRVTITCRASCDISSYLNWYQQKPGKAPKLLIYYTSRLHSGVPSRFSGSGSGTDFTFTISSLQPEDIATYYCQQGNTLPYTFGQGTKVEIK

SEQ ID NO: 207 - protein, 107 aa, Artificial Sequence
  VL
DIQMTQSPSSLSASVGDRVTITCRASQDISSCLNWYQQKPGKAPKLLIYYTSRLHSGVPSRFSGSGSGTDFTFTISSLQPEDIATYYCQQGNTLPYTFGQGTKVEIK

SEQ ID NO: 208 - protein, 107 aa, Artificial Sequence
  VL
DIQMTQSPSSLSASVGDRVTITCRASQDISSYCNWYQQKPGKAPKLLIYYTSRLHSGVPSRFSGSGSGTDFTFTISSLQPEDIATYYCQQGNTLPYTFGQGTKVEIK

SEQ ID NO: 209 - protein, 107 aa, Artificial Sequence
  VL
DIQMTQSPSSLSASVGDRVTITCRASQDISSYLCWYQQKPGKAPKLLIYYTSRLHSGVPSRFSGSGSGTDFTFTISSLQPEDIATYYCQQGNTLPYTFGQGTKVEIK

SEQ ID NO: 210 - protein, 107 aa, Artificial Sequence
  VL
DIQMTQSPSSLSASVGDRVTITCRASQDISSYLNWYQQKPGKAPKLLIYCTSRLHSGVPSRFSGSGSGTDFTFTISSLQPEDIATYYCQQGNTLPYTFGQGTKVEIK

SEQ ID NO: 211 - protein, 107 aa, Artificial Sequence
  VL
DIQMTQSPSSLSASVGDRVTITCRASQDISSYLNWYQQKPGKAPKLLIYYCSRLHSGVPSRFSGSGSGTDFTFTISSLQPEDIATYYCQQGNTLPYTFGQGTKVEIK

SEQ ID NO: 212 - protein, 107 aa, Artificial Sequence
  VL
DIQMTQSPSSLSASVGDRVTITCRASQDISSYLNWYQQKPGKAPKLLIYYTSRLCSGVPSRFSGSGSGTDFTFTISSLQPEDIATYYCQQGNTLPYTFGQGTKVEIK

SEQ ID NO: 213 - protein, 107 aa, Artificial Sequence
  VL
DIQMTQSPSSLSASVGDRVTITCRASQDISSYLNWYQQKPGKAPKLLIYYTSRLHCGVPSRFSGSGSGTDFTFTISSLQPEDIATYYCQQGNTLPYTFGQGTKVEIK

SEQ ID NO: 214 - protein, 107 aa, Artificial Sequence
  VL
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPCTFGQGTKVEIK

SEQ ID NO: 215 - protein, 107 aa, Artificial Sequence
  VL
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYCFGQGTKVEIK

SEQ ID NO: 216 - protein, 107 aa, Artificial Sequence
  CL
CTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 217 - protein, 107 aa, Artificial Sequence
  CL
RCVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 218 - protein, 107 aa, Artificial Sequence
  CL
RTCAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 219 - protein, 107 aa, Artificial Sequence
  CL
RTVCAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 220 - protein, 107 aa, Artificial Sequence
  CL
RTVACPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 221 - protein, 107 aa, Artificial Sequence
  CL
RTVAACSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 222 - protein, 107 aa, Artificial Sequence
  CL
RTVAAPCVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 223 - protein, 107 aa, Artificial Sequence
  CL
RTVAAPSCFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 224 - protein, 107 aa, Artificial Sequence
  CL
RTVAAPSVCIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 225 - protein, 107 aa, Artificial Sequence
  CL
RTVAAPSVFIFPCSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 226 - protein, 107 aa, Artificial Sequence
  CL
RTVAAPSVFIFPPCDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 227 - protein, 107 aa, Artificial Sequence
  CL
RTVAAPSVFIFPPSCEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 228 - protein, 107 aa, Artificial Sequence
  CL
RTVAAPSVFIFPPSDCQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 229 - protein, 107 aa, Artificial Sequence
  CL
RTVAAPSVFIFPPSDECLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 230 - protein, 107 aa, Artificial Sequence
  CL
RTVAAPSVFIFPPSDEQCKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 231 - protein, 107 aa, Artificial Sequence
  CL
RTVAAPSVFIFPPSDEQLCSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 232 - protein, 107 aa, Artificial Sequence
  CL
RTVAAPSVFIFPPSDEQLKCGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 233 - protein, 107 aa, Artificial Sequence
  CL
RTVAAPSVFIFPPSDEQLKSCTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 234 - protein, 107 aa, Artificial Sequence
  CL
RTVAAPSVFIFPPSDEQLKSGCASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 235 - protein, 107 aa, Artificial Sequence
  CL
RTVAAPSVFIFPPSDEQLKSGTCSVVCLLNNFYPREAKVQWKVDNALQSGNSQESVTEQDSKDSTYSLSSTLTLSKADYEKHKVYACEVTHQGLSSPVTKSFNRGEC

SEQ ID NO: 236 - protein, 107 aa, Artificial Sequence
  CL
RTVAAPSVFIFPPSDEQLKSGTACVVCLLNNFYPREAKVQWKVDNALQSGNSQESVTEQDSKDSTYSLSSTLTLSKADYEKHKVYACEVTHQGLSSPVTKSFNRGEC

SEQ ID NO: 237 - protein, 107 aa, Artificial Sequence
  CL
RTVAAPSVFIFPPSDEQLKSGTASVVCLCNNFYPREAKVQWKVDNALQSGNSQESVTEQDSKDSTYSLSSTLTLSKADYEKHKVYACEVTHQGLSSPVTKSFNRGEC

SEQ ID NO: 238 - protein, 107 aa, Artificial Sequence
  CL
RTVAAPSVFIFPPSDEQLKSGTASVVCLLCNFYPREAKVQWKVDNALQSGNSQESVTEQDSKDSTYSLSSTLTLSKADYEKHKVYACEVTHQGLSSPVTKSFNRGEC

SEQ ID NO: 239 - protein, 107 aa, Artificial Sequence
  CL
RTVAAPSVFIFPPSDEQLKSGTASVVCLLNCFYPREAKVQWKVDNALQSGNSQESVTEQDSKDSTYSLSSTLTLSKADYEKHKVYACEVTHQGLSSPVTKSFNRGEC

SEQ ID NO: 240 - protein, 107 aa, Artificial Sequence
  CL
RTVAAPSVFIFPPSDEQLKSGTASVVCLLNNCYPREAKVQWKVDNALQSGNSQESVTEQDSKDSTYSLSSTLTLSKADYEKHKVYACEVTHQGLSSPVTKSFNRGEC

SEQ ID NO: 241 - protein, 107 aa, Artificial Sequence
  CL
RTVAAPSVFIFPPSDEQLKSGTASVVCLLNNFCPREAKVQWKVDNALQSGNSQESVTEQDSKDSTYSLSSTLTLSKADYEKHKVYACEVTHQGLSSPVTKSFNRGEC

SEQ ID NO: 242 - protein, 107 aa, Artificial Sequence
  CL
RTVAAPSVFIFPPSDEQLKSGTASVVCLLNNFYCREAKVQWKVDNALQSGNSQESVTEQDSKDSTYSLSSTLTLSKADYEKHKVYACEVTHQGLSSPVTKSFNRGEC

SEQ ID NO: 243 - protein, 107 aa, Artificial Sequence
  CL
RTVAAPSVFIFPPSDEQLKSGTASVVCLLNNFYPCEAKVQWKVDNALQSGNSQESVTEQDSKDSTYSLSSTLTLSKADYEKHKVYACEVTHQGLSSPVTKSFNRGEC

SEQ ID NO: 244 - protein, 107 aa, Artificial Sequence
  CL
RTVAAPSVFIFPPSDEQLKSGTASVVCLLNNFYPRCAKVQWKVDNALQSGNSQESVTEQDSKDSTYSLSSTLTLSKADYEKHKVYACEVTHQGLSSPVTKSFNRGEC

SEQ ID NO: 245 - protein, 107 aa, Artificial Sequence
  CL
RTVAAPSVFIFPPSDEQLKSGTASVVCLLNNFYPRECKVQWKVDNALQSGNSQESVTEQDSKDSTYSLSSTLTLSKADYEKHKVYACEVTHQGLSSPVTKSFNRGEC

SEQ ID NO: 246 - protein, 107 aa, Artificial Sequence
  CL
RTVAAPSVFIFPPSDEQLKSGTASVVCLLNNFYPREACVQWKVDNALQSGNSQESVTEQDSKDSTYSLSSTLTLSKADYEKHKVYACEVTHQGLSSPVTKSFNRGEC

SEQ ID NO: 247 - protein, 107 aa, Artificial Sequence
  CL
RTVAAPSVFIFPPSDEQLKSGTASVVCLLNNFYPREAKCQWKVDNALQSGNSQESVTEQDSKDSTYSLSSTLTLSKADYEKHKVYACEVTHQGLSSPVTKSFNRGEC

SEQ ID NO: 248 - protein, 107 aa, Artificial Sequence
  CL
RTVAAPSVFIFPPSDEQLKSGTASVVCLLNNFYPREAKVCWKVDNALQSGNSQESVTEQDSKDSTYSLSSTLTLSKADYEKHKVYACEVTHQGLSSPVTKSFNRGEC

SEQ ID NO: 249 - protein, 107 aa, Artificial Sequence
  CL
RTVAAPSVFIFPPSDEQLKSGTASVVCLLNNFYPREAKVQCKVDNALQSGNSQESVTEQDSKDSTYSLSSTLTLSKADYEKHKVYACEVTHQGLSSPVTKSFNRGEC

SEQ ID NO: 250 - protein, 107 aa, Artificial Sequence
  CL
RTVAAPSVFIFPPSDEQLKSGTASVVCLLNNFYPREAKVQWCVDNALQSGNSQESVTEQDSKDSTYSLSSTLTLSKADYEKHKVYACEVTHQGLSSPVTKSFNRGEC

SEQ ID NO: 251 - protein, 107 aa, Artificial Sequence
  CL
RTVAAPSVFIFPPSDEQLKSGTASVVCLLNNFYPREAKVQWKCDNALQSGNSQESVTEQDSKDSTYSLSSTLTLSKADYEKHKVYACEVTHQGLSSPVTKSFNRGEC

SEQ ID NO: 252 - protein, 107 aa, Artificial Sequence
  CL
RTVAAPSVFIFPPSDEQLKSGTASVVCLLNNFYPREAKVQWKVCNALQSGNSQESVTEQDSKDSTYSLSSTLTLSKADYEKHKVYACEVTHQGLSSPVTKSFNRGEC

SEQ ID NO: 253 - protein, 107 aa, Artificial Sequence
  CL
RTVAAPSVFIFPPSDEQLKSGTASVVCLLNNFYPREAKVQWKVDCALQSGNSQESVTEQDSKDSTYSLSSTLTLSKADYEKHKVYACEVTHQGLSSPVTKSFNRGEC

SEQ ID NO: 254 - protein, 107 aa, Artificial Sequence
  CL
RTVAAPSVFIFPPSDEQLKSGTASVVCLLNNFYPREAKVQWKVDNCLQSGNSQESVTEQDSKDSTYSLSSTLTLSKADYEKHKVYACEVTHQGLSSPVTKSFNRGEC

SEQ ID NO: 255 - protein, 107 aa, Artificial Sequence
  CL
RTVAAPSVFIFPPSDEQLKSGTASVVCLLNNFYPREAKVQWKVDNACQSGNSQESVTEQDSKDSTYSLSSTLTLSKADYEKHKVYACEVTHQGLSSPVTKSFNRGEC

SEQ ID NO: 256 - protein, 107 aa, Artificial Sequence
  CL
RTVAAPSVFIFPPSDEQLKSGTASVVCLLNNFYPREAKVQWKVDNALCSGNSQESVTEQDSKDSTYSLSSTLTLSKADYEKHKVYACEVTHQGLSSPVTKSFNRGEC

SEQ ID NO: 257 - protein, 107 aa, Artificial Sequence
  CL
RTVAAPSVFIFPPSDEQLKSGTASVVCLLNNFYPREAKVQWKVDNALQCGNSQESVTEQDSKDSTYSLSSTLTLSKADYEKHKVYACEVTHQGLSSPVTKSFNRGEC

SEQ ID NO: 258 - protein, 107 aa, Artificial Sequence
  CL
RTVAAPSVFIFPPSDEQLKSGTASVVCLLNNFYPREAKVQWKVDNALQSCNSQESVTEQDSKDSTYSLSSTLTLSKADYEKHKVYACEVTHQGLSSPVTKSFNRGEC

SEQ ID NO: 259 - protein, 107 aa, Artificial Sequence
  CL
RTVAAPSVFIFPPSDEQLKSGTASVVCLLNNFYPREAKVQWKVDNALQSGCSQESVTEQDSKDSTYSLSSTLTLSKADYEKHKVYACEVTHQGLSSPVTKSFNRGEC

SEQ ID NO: 260 - protein, 107 aa, Artificial Sequence
  CL
RTVAAPSVFIFPPSDEQLKSGTASVVCLLNNFYPREAKVQWKVDNALQSGNCQESVTEQDSKDSTYSLSSTLTLSKADYEKHKVYACEVTHQGLSSPVTKSFNRGEC

SEQ ID NO: 261 - protein, 107 aa, Artificial Sequence
  CL
RTVAAPSVFIFPPSDEQLKSGTASVVCLLNNFYPREAKVQWKVDNALQSGNSCESVTEQDSKDSTYSLSSTLTLSKADYEKHKVYACEVTHQGLSSPVTKSFNRGEC

SEQ ID NO: 262 - protein, 107 aa, Artificial Sequence
  CL
RTVAAPSVFIFPPSDEQLKSGTASVVCLLNNFYPREAKVQWKVDNALQSGNSQCSVTEQDSKDSTYSLSSTLTLSKADYEKHKVYACEVTHQGLSSPVTKSFNRGEC

SEQ ID NO: 263 - protein, 107 aa, Artificial Sequence
  CL
RTVAAPSVFIFPPSDEQLKSGTASVVCLLNNFYPREAKVQWKVDNALQSGNSQECVTEQDSKDSTYSLSSTLTLSKADYEKHKVYACEVTHQGLSSPVTKSFNRGEC

SEQ ID NO: 264 - protein, 107 aa, Artificial Sequence
  CL
RTVAAPSVFIFPPSDEQLKSGTASVVCLLNNFYPREAKVQWKVDNALQSGNSQESCTEQDSKDSTYSLSSTLTLSKADYEKHKVYACEVTHQGLSSPVTKSFNRGEC

SEQ ID NO: 265 - protein, 107 aa, Artificial Sequence
  CL
RTVAAPSVFIFPPSDEQLKSGTASVVCLLNNFYPREAKVQWKVDNALQSGNSQESVCEQDSKDSTYSLSSTLTLSKADYEKHKVYACEVTHQGLSSPVTKSFNRGEC

SEQ ID NO: 266 - protein, 107 aa, Artificial Sequence
  CL
RTVAAPSVFIFPPSDEQLKSGTASVVCLLNNFYPREAKVQWKVDNALQSGNSQESVTCQDSKDSTYSLSSTLTLSKADYEKHKVYACEVTHQGLSSPVTKSFNRGEC

SEQ ID NO: 267 - protein, 107 aa, Artificial Sequence
  CL
RTVAAPSVFIFPPSDEQLKSGTASVVCLLNNFYPREAKVQWKVDNALQSGNSQESVTECDSKDSTYSLSSTLTLSKADYEKHKVYACEVTHQGLSSPVTKSFNRGEC

SEQ ID NO: 268 - protein, 107 aa, Artificial Sequence
  CL
RTVAAPSVFIFPPSDEQLKSGTASVVCLLNNFYPREAKVQWKVDNALQSGNSQESVTEQCSKDSTYSLSSTLTLSKADYEKHKVYACEVTHQGLSSPVTKSFNRGEC

SEQ ID NO: 269 - protein, 107 aa, Artificial Sequence
  CL
RTVAAPSVFIFPPSDEQLKSGTASVVCLLNNFYPREAKVQWKVDNALQSGNSQESVTEQDCKDSTYSLSSTLTLSKADYEKHKVYACEVTHQGLSSPVTKSFNRGEC

SEQ ID NO: 270 - protein, 107 aa, Artificial Sequence
  CL
RTVAAPSVFIFPPSDEQLKSGTASVVCLLNNFYPREAKVQWKVDNALQSGNSQESVTEQDSCDSTYSLSSTLTLSKADYEKHKVYACEVTHQGLSSPVTKSFNRGEC

SEQ ID NO: 271 - protein, 107 aa, Artificial Sequence
  CL
RTVAAPSVFIFPPSDEQLKSGTASVVCLLNNFYPREAKVQWKVDNALQSGNSQESVTEQDSKCSTYSLSSTLTLSKADYEKHKVYACEVTHQGLSSPVTKSFNRGEC

SEQ ID NO: 272 - protein, 107 aa, Artificial Sequence
  CL
RTVAAPSVFIFPPSDEQLKSGTASVVCLLNNFYPREAKVQWKVDNALQSGNSQESVTEQDSKDCTYSLSSTLTLSKADYEKHKVYACEVTHQGLSSPVTKSFNRGEC

SEQ ID NO: 273 - protein, 107 aa, Artificial Sequence
  CL
RTVAAPSVFIFPPSDEQLKSGTASVVCLLNNFYPREAKVQWKVDNALQSGNSQESVTEQDSKDSCYSLSSTLTLSKADYEKHKVYACEVTHQGLSSPVTKSFNRGEC

SEQ ID NO: 274 - protein, 107 aa, Artificial Sequence
  CL
RTVAAPSVFIFPPSDEQLKSGTASVVCLLNNFYPREAKVQWKVDNALQSGNSQESVTEQDSKDSTCSLSSTLTLSKADYEKHKVYACEVTHQGLSSPVTKSFNRGEC

SEQ ID NO: 275 - protein, 107 aa, Artificial Sequence
  CL
RTVAAPSVFIFPPSDEQLKSGTASVVCLLNNFYPREAKVQWKVDNALQSGNSQESVTEQDSKDSTYCLSSTLTLSKADYEKHKVYACEVTHQGLSSPVTKSFNRGEC

SEQ ID NO: 276 - protein, 107 aa, Artificial Sequence
  CL
RTVAAPSVFIFPPSDEQLKSGTASVVCLLNNFYPREAKVQWKVDNALQSGNSQESVTEQDSKDSTYSCSSTLTLSKADYEKHKVYACEVTHQGLSSPVTKSFNRGEC

SEQ ID NO: 277 - protein, 107 aa, Artificial Sequence
  CL
RTVAAPSVFIFPPSDEQLKSGTASVVCLLNNFYPREAKVQWKVDNALQSGNSQESVTEQDSKDSTYSLSSTLCLSKADYEKHKVYACEVTHQGLSSPVTKSFNRGEC

SEQ ID NO: 278 - protein, 107 aa, Artificial Sequence
  CL
RTVAAPSVFIFPPSDEQLKSGTASVVCLLNNFYPREAKVQWKVDNALQSGNSQESVTEQDSKDSTYSLSSTLTCSKADYEKHKVYACEVTHQGLSSPVTKSFNRGEC

SEQ ID NO: 279 - protein, 107 aa, Artificial Sequence
  CL
RTVAAPSVFIFPPSDEQLKSGTASVVCLLNNFYPREAKVQWKVDNALQSGNSQESVTEQDSKDSTYSLSSTLTLCKADYEKHKVYACEVTHQGLSSPVTKSFNRGEC

SEQ ID NO: 280 - protein, 107 aa, Artificial Sequence
  CL
RTVAAPSVFIFPPSDEQLKSGTASVVCLLNNFYPREAKVQWKVDNALQSGNSQESVTEQDSKDSTYSLSSTLTLSCADYEKHKVYACEVTHQGLSSPVTKSFNRGEC

SEQ ID NO: 281 - protein, 107 aa, Artificial Sequence
  CL
RTVAAPSVFIFPPSDEQLKSGTASVVCLLNNFYPREAKVQWKVDNALQSGNSQESVTEQDSKDSTYSLSSTLTLSKCDYEKHKVYACEVTHQGLSSPVTKSFNRGEC

SEQ ID NO: 282 - protein, 107 aa, Artificial Sequence
  CL
RTVAAPSVFIFPPSDEQLKSGTASVVCLLNNFYPREAKVQWKVDNALQSGNSQESVTEQDSKDSTYSLSSTLTLSKACYEKHKVYACEVTHQGLSSPVTKSFNRGEC

SEQ ID NO: 283 - protein, 107 aa, Artificial Sequence
  CL
RTVAAPSVFIFPPSDEQLKSGTASVVCLLNNFYPREAKVQWKVDNALQSGNSQESVTEQDSKDSTYSLSSTLTLSKADCEKHKVYACEVTHQGLSSPVTKSFNRGEC

SEQ ID NO: 284 - protein, 107 aa, Artificial Sequence
  CL
RTVAAPSVFIFPPSDEQLKSGTASVVCLLNNFYPREAKVQWKVDNALQSGNSQESVTEQDSKDSTYSLSSTLTLSKADYCKHKVYACEVTHQGLSSPVTKSFNRGEC

SEQ ID NO: 285 - protein, 107 aa, Artificial Sequence
  CL
RTVAAPSVFIFPPSDEQLKSGTASVVCLLNNFYPREAKVQWKVDNALQSGNSQESVTEQDSKDSTYSLSSTLTLSKADYECHKVYACEVTHQGLSSPVTKSFNRGEC

SEQ ID NO: 286 - protein, 107 aa, Artificial Sequence
  CL
RTVAAPSVFIFPPSDEQLKSGTASVVCLLNNFYPREAKVQWKVDNALQSGNSQESVTEQDSKDSTYSLSSTLTLSKADYEKCKVYACEVTHQGLSSPVTKSFNRGEC

SEQ ID NO: 287 - protein, 107 aa, Artificial Sequence
  CL
RTVAAPSVFIFPPSDEQLKSGTASVVCLLNNFYPREAKVQWKVDNALQSGNSQESVTEQDSKDSTYSLSSTLTLSKADYEKHCVYACEVTHQGLSSPVTKSFNRGEC

SEQ ID NO: 288 - protein, 107 aa, Artificial Sequence
  CL
RTVAAPSVFIFPPSDEQLKSGTASVVCLLNNFYPREAKVQWKVDNALQSGNSQESVTEQDSKDSTYSLSSTLTLSKADYEKHKCYACEVTHQGLSSPVTKSFNRGEC

SEQ ID NO: 289 - protein, 107 aa, Artificial Sequence
  CL
RTVAAPSVFIFPPSDEQLKSGTASVVCLLNNFYPREAKVQWKVDNALQSGNSQESVTEQDSKDSTYSLSSTLTLSKADYEKHKVCACEVTHQGLSSPVTKSFNRGEC

SEQ ID NO: 290 - protein, 107 aa, Artificial Sequence
  CL
RTVAAPSVFIFPPSDEQLKSGTASVVCLLNNFYPREAKVQWKVDNALQSGNSQESVTEQDSKDSTYSLSSTLTLSKADYEKHKVYCCEVTHQGLSSPVTKSFNRGEC

SEQ ID NO: 291 - protein, 107 aa, Artificial Sequence
  CL
RTVAAPSVFIFPPSDEQLKSGTASVVCLLNNFYPREAKVQWKVDNALQSGNSQESVTEQDSKDSTYSLSSTLTLSKADYEKHKVYACCVTHQGLSSPVTKSFNRGEC

SEQ ID NO: 292 - protein, 107 aa, Artificial Sequence
  CL
RTVAAPSVFIFPPSDEQLKSGTASVVCLLNNFYPREAKVQWKVDNALQSGNSQESVTEQDSKDSTYSLSSTLTLSKADYEKHKVYACECTHQGLSSPVTKSFNRGEC

SEQ ID NO: 293 - protein, 107 aa, Artificial Sequence
  CL
RTVAAPSVFIFPPSDEQLKSGTASVVCLLNNFYPREAKVQWKVDNALQSGNSQESVTEQDSKDSTYSLSSTLTLSKADYEKHKVYACEVCHQGLSSPVTKSFNRGEC

SEQ ID NO: 294 - protein, 107 aa, Artificial Sequence
  CL
RTVAAPSVFIFPPSDEQLKSGTASVVCLLNNFYPREAKVQWKVDNALQSGNSQESVTEQDSKDSTYSLSSTLTLSKADYEKHKVYACEVTCQGLSSPVTKSFNRGEC

SEQ ID NO: 295 - protein, 107 aa, Artificial Sequence
  CL
RTVAAPSVFIFPPSDEQLKSGTASVVCLLNNFYPREAKVQWKVDNALQSGNSQESVTEQDSKDSTYSLSSTLTLSKADYEKHKVYACEVTHCGLSSPVTKSFNRGEC

SEQ ID NO: 296 - protein, 107 aa, Artificial Sequence
  CL
RTVAAPSVFIFPPSDEQLKSGTASVVCLLNNFYPREAKVQWKVDNALQSGNSQESVTEQDSKDSTYSLSSTLTLSKADYEKHKVYACEVTHQCLSSPVTKSFNRGEC

SEQ ID NO: 297 - protein, 107 aa, Artificial Sequence
  CL
RTVAAPSVFIFPPSDEQLKSGTASVVCLLNNFYPREAKVQWKVDNALQSGNSQESVTEQDSKDSTYSLSSTLTLSKADYEKHKVYACEVTHQGCSSPVTKSFNRGEC

SEQ ID NO: 298 - protein, 107 aa, Artificial Sequence
  CL
RTVAAPSVFIFPPSDEQLKSGTASVVCLLNNFYPREAKVQWKVDNALQSGNSQESVTEQDSKDSTYSLSSTLTLSKADYEKHKVYACEVTHQGLCSPVTKSFNRGEC

SEQ ID NO: 299 - protein, 107 aa, Artificial Sequence
  CL
RTVAAPSVFIFPPSDEQLKSGTASVVCLLNNFYPREAKVQWKVDNALQSGNSQESVTEQDSKDSTYSLSSTLTLSKADYEKHKVYACEVTHQGLSCPVTKSFNRGEC

SEQ ID NO: 300 - protein, 107 aa, Artificial Sequence
  CL
RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSCVTKSFNRGEC

SEQ ID NO: 301 - protein, 107 aa, Artificial Sequence
  CL
RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPCTKSFNRGEC

SEQ ID NO: 302 - protein, 107 aa, Artificial Sequence
  CL
RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVCKSFNRGEC

SEQ ID NO: 303 - protein, 107 aa, Artificial Sequence
  CL
RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTCSFNRGEC

SEQ ID NO: 304 - protein, 107 aa, Artificial Sequence
  CL
RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKCFNRGEC

SEQ ID NO: 305 - protein, 107 aa, Artificial Sequence
  CL
RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSCNRGEC

SEQ ID NO: 306 - protein, 107 aa, Artificial Sequence
  CL
RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFCRGEC

SEQ ID NO: 307 - protein, 107 aa, Artificial Sequence
  CL
RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNCGEC

SEQ ID NO: 308 - protein, 107 aa, Artificial Sequence
  CL
RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRCEC

SEQ ID NO: 309 - protein, 107 aa, Artificial Sequence
  CL
RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGCC

SEQ ID NO: 310 - protein, 444 aa, Artificial Sequence
  Hch
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPCSRSTSESTAALGCLVKDYFPEPVTVSWNSGALTSGVHTFPAVLQSSGLYSLSSVVTVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 311 - protein, 325 aa, Artificial Sequence
  CH
ASTKGPSVFPLAPCSRSTSESTAALGCLVKDYFPEPVTVSWNSGALTSGVHTFPAVLQSSGLYSLSSVVTVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 312 - protein, 443 aa, Artificial Sequence
  Hch
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 313 - protein, 324 aa, Artificial Sequence
  CH
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 314 - protein, 462 aa, Artificial Sequence
  Hch
QVQLVQSGAEVKKPGSSVTVSCKASGGTFSSFSITWLRQAPGQGLEWMGEITPMFGIANYAQKFQGRVTISADESTSTAYMELSGLTSEDTAMYYCARDGRFDVSDLLTDKPKVTINYNGMDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 315 - protein, 134 aa, Artificial Sequence
  VH
QVQLVQSGAEVKKPGSSVTVSCKASGGTFSSFSITWLRQAPGQGLEWMGEITPMFGIANYAQKFQGRVTISADESTSTAYMELSGLTSEDTAMYYCARDGRFDVSDLLTDKPKVTINYNGMDVWGQGTLVTVSS

SEQ ID NO: 316 - protein, 216 aa, Artificial Sequence
  Lch
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 317 - protein, 110 aa, Artificial Sequence
  VL
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVL

SEQ ID NO: 318 - protein, 106 aa, Artificial Sequence
  CL
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 319 - protein, 127 aa, Artificial Sequence
  VHH
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 320 - protein, 230 aa, Artificial Sequence
  CH
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 321 - protein, 357 aa, Artificial Sequence
  Hch
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSSEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 322 - protein, 119 aa, Artificial Sequence; identical to SEQ ID NO: 21
  VH

SEQ ID NO: 323 - protein, 119 aa, Artificial Sequence; identical to SEQ ID NO: 22
  VH

SEQ ID NO: 324 - protein, 119 aa, Artificial Sequence; identical to SEQ ID NO: 23
  VH

SEQ ID NO: 325 - protein, 119 aa, Artificial Sequence; identical to SEQ ID NO: 24
  VH

SEQ ID NO: 326 - protein, 119 aa, Artificial Sequence; identical to SEQ ID NO: 25
  VH

SEQ ID NO: 327 - protein, 119 aa, Artificial Sequence; identical to SEQ ID NO: 26
  VH

SEQ ID NO: 328 - protein, 119 aa, Artificial Sequence; identical to SEQ ID NO: 27
  VH

SEQ ID NO: 329 - protein, 119 aa, Artificial Sequence; identical to SEQ ID NO: 28
  VH

SEQ ID NO: 330 - protein, 119 aa, Artificial Sequence; identical to SEQ ID NO: 29
  VH

SEQ ID NO: 331 - protein, 119 aa, Artificial Sequence; identical to SEQ ID NO: 30
  VH

SEQ ID NO: 332 - protein, 119 aa, Artificial Sequence; identical to SEQ ID NO: 31
  VH

SEQ ID NO: 333 - protein, 119 aa, Artificial Sequence; identical to SEQ ID NO: 32
  VH

SEQ ID NO: 334 - protein, 119 aa, Artificial Sequence; identical to SEQ ID NO: 33
  VH

SEQ ID NO: 335 - protein, 119 aa, Artificial Sequence; identical to SEQ ID NO: 34
  VH

SEQ ID NO: 336 - protein, 119 aa, Artificial Sequence; identical to SEQ ID NO: 35
  VH

SEQ ID NO: 337 - protein, 119 aa, Artificial Sequence; identical to SEQ ID NO: 36
  VH

SEQ ID NO: 338 - protein, 119 aa, Artificial Sequence; identical to SEQ ID NO: 37
  VH

SEQ ID NO: 339 - protein, 119 aa, Artificial Sequence; identical to SEQ ID NO: 38
  VH

SEQ ID NO: 340 - protein, 119 aa, Artificial Sequence; identical to SEQ ID NO: 39
  VH

SEQ ID NO: 341 - protein, 119 aa, Artificial Sequence; identical to SEQ ID NO: 40
  VH

SEQ ID NO: 342 - protein, 119 aa, Artificial Sequence; identical to SEQ ID NO: 41
  VH

SEQ ID NO: 343 - protein, 119 aa, Artificial Sequence; identical to SEQ ID NO: 42
  VH

SEQ ID NO: 344 - protein, 119 aa, Artificial Sequence; identical to SEQ ID NO: 62
  VH

SEQ ID NO: 345 - protein, 119 aa, Artificial Sequence; identical to SEQ ID NO: 63
  VH

SEQ ID NO: 346 - protein, 119 aa, Artificial Sequence; identical to SEQ ID NO: 64
  VH

SEQ ID NO: 347 - protein, 119 aa, Artificial Sequence; identical to SEQ ID NO: 65
  VH

SEQ ID NO: 348 - protein, 119 aa, Artificial Sequence; identical to SEQ ID NO: 66
  VH

SEQ ID NO: 349 - protein, 119 aa, Artificial Sequence; identical to SEQ ID NO: 67
  VH

SEQ ID NO: 350 - protein, 119 aa, Artificial Sequence; identical to SEQ ID NO: 68
  VH

SEQ ID NO: 351 - protein, 119 aa, Artificial Sequence; identical to SEQ ID NO: 69
  VH

SEQ ID NO: 352 - protein, 119 aa, Artificial Sequence; identical to SEQ ID NO: 70
  VH

SEQ ID NO: 353 - protein, 119 aa, Artificial Sequence; identical to SEQ ID NO: 71
  VH

SEQ ID NO: 354 - protein, 119 aa, Artificial Sequence; identical to SEQ ID NO: 43
  VH

SEQ ID NO: 355 - protein, 119 aa, Artificial Sequence; identical to SEQ ID NO: 44
  VH

SEQ ID NO: 356 - protein, 119 aa, Artificial Sequence; identical to SEQ ID NO: 45
  VH

SEQ ID NO: 357 - protein, 119 aa, Artificial Sequence; identical to SEQ ID NO: 46
  VH

SEQ ID NO: 358 - protein, 119 aa, Artificial Sequence; identical to SEQ ID NO: 47
  VH

SEQ ID NO: 359 - protein, 119 aa, Artificial Sequence; identical to SEQ ID NO: 48
  VH

SEQ ID NO: 360 - protein, 119 aa, Artificial Sequence; identical to SEQ ID NO: 49
  VH

SEQ ID NO: 361 - protein, 119 aa, Artificial Sequence; identical to SEQ ID NO: 50
  VH

SEQ ID NO: 362 - protein, 119 aa, Artificial Sequence; identical to SEQ ID NO: 51
  VH

SEQ ID NO: 363 - protein, 119 aa, Artificial Sequence; identical to SEQ ID NO: 52
  VH

SEQ ID NO: 364 - protein, 119 aa, Artificial Sequence; identical to SEQ ID NO: 53
  VH

SEQ ID NO: 365 - protein, 119 aa, Artificial Sequence; identical to SEQ ID NO: 54
  VH

SEQ ID NO: 366 - protein, 119 aa, Artificial Sequence; identical to SEQ ID NO: 55
  VH

SEQ ID NO: 367 - protein, 119 aa, Artificial Sequence; identical to SEQ ID NO: 56
  VH

SEQ ID NO: 368 - protein, 119 aa, Artificial Sequence; identical to SEQ ID NO: 57
  VH

SEQ ID NO: 369 - protein, 119 aa, Artificial Sequence; identical to SEQ ID NO: 58
  VH

SEQ ID NO: 370 - protein, 119 aa, Artificial Sequence; identical to SEQ ID NO: 59
  VH

SEQ ID NO: 371 - protein, 119 aa, Artificial Sequence; identical to SEQ ID NO: 72
  VH

SEQ ID NO: 372 - protein, 119 aa, Artificial Sequence; identical to SEQ ID NO: 73
  VH

SEQ ID NO: 373 - protein, 119 aa, Artificial Sequence; identical to SEQ ID NO: 60
  VH

SEQ ID NO: 374 - protein, 119 aa, Artificial Sequence; identical to SEQ ID NO: 61
  VH

SEQ ID NO: 375 - protein, 328 aa, Artificial Sequence; identical to SEQ ID NO: 74
  CH

SEQ ID NO: 376 - protein, 328 aa, Artificial Sequence; identical to SEQ ID NO: 75
  CH

SEQ ID NO: 377 - protein, 328 aa, Artificial Sequence; identical to SEQ ID NO: 76
  CH

SEQ ID NO: 378 - protein, 328 aa, Artificial Sequence; identical to SEQ ID NO: 77
  CH

SEQ ID NO: 379 - protein, 328 aa, Artificial Sequence; identical to SEQ ID NO: 78
  CH

SEQ ID NO: 380 - protein, 328 aa, Artificial Sequence; identical to SEQ ID NO: 79
  CH

SEQ ID NO: 381 - protein, 328 aa, Artificial Sequence; identical to SEQ ID NO: 80
  CH

SEQ ID NO: 382 - protein, 328 aa, Artificial Sequence; identical to SEQ ID NO: 81
  CH

SEQ ID NO: 383 - protein, 328 aa, Artificial Sequence; identical to SEQ ID NO: 82
  CH

SEQ ID NO: 384 - protein, 328 aa, Artificial Sequence; identical to SEQ ID NO: 83
  CH

SEQ ID NO: 385 - protein, 328 aa, Artificial Sequence; identical to SEQ ID NO: 84
  CH

SEQ ID NO: 386 - protein, 328 aa, Artificial Sequence; identical to SEQ ID NO: 85
  CH

SEQ ID NO: 387 - protein, 328 aa, Artificial Sequence; identical to SEQ ID NO: 86
  CH

SEQ ID NO: 388 - protein, 328 aa, Artificial Sequence; identical to SEQ ID NO: 87
  CH

SEQ ID NO: 389 - protein, 328 aa, Artificial Sequence; identical to SEQ ID NO: 88
  CH

SEQ ID NO: 390 - protein, 328 aa, Artificial Sequence; identical to SEQ ID NO: 89
  CH

SEQ ID NO: 391 - protein, 328 aa, Artificial Sequence; identical to SEQ ID NO: 90
  CH

SEQ ID NO: 392 - protein, 328 aa, Artificial Sequence; identical to SEQ ID NO: 91
  CH

SEQ ID NO: 393 - protein, 328 aa, Artificial Sequence; identical to SEQ ID NO: 92
  CH

SEQ ID NO: 394 - protein, 328 aa, Artificial Sequence; identical to SEQ ID NO: 93
  CH

SEQ ID NO: 395 - protein, 328 aa, Artificial Sequence; identical to SEQ ID NO: 94
  CH

SEQ ID NO: 396 - protein, 328 aa, Artificial Sequence; identical to SEQ ID NO: 95
  CH

SEQ ID NO: 397 - protein, 328 aa, Artificial Sequence; identical to SEQ ID NO: 96
  CH

SEQ ID NO: 398 - protein, 328 aa, Artificial Sequence; identical to SEQ ID NO: 97
  CH

SEQ ID NO: 399 - protein, 328 aa, Artificial Sequence; identical to SEQ ID NO: 98
  CH

SEQ ID NO: 400 - protein, 328 aa, Artificial Sequence; identical to SEQ ID NO: 99
  CH

SEQ ID NO: 401 - protein, 328 aa, Artificial Sequence; identical to SEQ ID NO: 100
  CH

SEQ ID NO: 402 - protein, 328 aa, Artificial Sequence; identical to SEQ ID NO: 101
  CH

SEQ ID NO: 403 - protein, 328 aa, Artificial Sequence; identical to SEQ ID NO: 102
  CH

SEQ ID NO: 404 - protein, 328 aa, Artificial Sequence; identical to SEQ ID NO: 103
  CH

SEQ ID NO: 405 - protein, 328 aa, Artificial Sequence; identical to SEQ ID NO: 104
  CH

SEQ ID NO: 406 - protein, 328 aa, Artificial Sequence; identical to SEQ ID NO: 105
  CH

SEQ ID NO: 407 - protein, 328 aa, Artificial Sequence; identical to SEQ ID NO: 106
  CH

SEQ ID NO: 408 - protein, 328 aa, Artificial Sequence; identical to SEQ ID NO: 107
  CH

SEQ ID NO: 409 - protein, 328 aa, Artificial Sequence; identical to SEQ ID NO: 108
  CH

SEQ ID NO: 410 - protein, 328 aa, Artificial Sequence; identical to SEQ ID NO: 109
  CH

SEQ ID NO: 411 - protein, 328 aa, Artificial Sequence; identical to SEQ ID NO: 110
  CH

SEQ ID NO: 412 - protein, 328 aa, Artificial Sequence; identical to SEQ ID NO: 111
  CH

SEQ ID NO: 413 - protein, 328 aa, Artificial Sequence; identical to SEQ ID NO: 112
  CH

SEQ ID NO: 414 - protein, 328 aa, Artificial Sequence; identical to SEQ ID NO: 113
  CH

SEQ ID NO: 415 - protein, 328 aa, Artificial Sequence; identical to SEQ ID NO: 114
  CH

SEQ ID NO: 416 - protein, 328 aa, Artificial Sequence; identical to SEQ ID NO: 115
  CH

SEQ ID NO: 417 - protein, 328 aa, Artificial Sequence; identical to SEQ ID NO: 116
  CH

SEQ ID NO: 418 - protein, 328 aa, Artificial Sequence; identical to SEQ ID NO: 117
  CH

SEQ ID NO: 419 - protein, 328 aa, Artificial Sequence; identical to SEQ ID NO: 118
  CH

SEQ ID NO: 420 - protein, 328 aa, Artificial Sequence; identical to SEQ ID NO: 119
  CH

SEQ ID NO: 421 - protein, 328 aa, Artificial Sequence; identical to SEQ ID NO: 120
  CH

SEQ ID NO: 422 - protein, 328 aa, Artificial Sequence; identical to SEQ ID NO: 121
  CH

SEQ ID NO: 423 - protein, 328 aa, Artificial Sequence; identical to SEQ ID NO: 122
  CH

SEQ ID NO: 424 - protein, 328 aa, Artificial Sequence; identical to SEQ ID NO: 123
  CH

SEQ ID NO: 425 - protein, 328 aa, Artificial Sequence; identical to SEQ ID NO: 124
  CH

SEQ ID NO: 426 - protein, 328 aa, Artificial Sequence; identical to SEQ ID NO: 125
  CH

SEQ ID NO: 427 - protein, 328 aa, Artificial Sequence; identical to SEQ ID NO: 126
  CH

SEQ ID NO: 428 - protein, 328 aa, Artificial Sequence; identical to SEQ ID NO: 127
  CH

SEQ ID NO: 429 - protein, 328 aa, Artificial Sequence; identical to SEQ ID NO: 128
  CH

SEQ ID NO: 430 - protein, 328 aa, Artificial Sequence; identical to SEQ ID NO: 129
  CH

SEQ ID NO: 431 - protein, 328 aa, Artificial Sequence; identical to SEQ ID NO: 130
  CH

SEQ ID NO: 432 - protein, 328 aa, Artificial Sequence; identical to SEQ ID NO: 131
  CH

SEQ ID NO: 433 - protein, 328 aa, Artificial Sequence; identical to SEQ ID NO: 132
  CH

SEQ ID NO: 434 - protein, 328 aa, Artificial Sequence; identical to SEQ ID NO: 133
  CH

SEQ ID NO: 435 - protein, 328 aa, Artificial Sequence; identical to SEQ ID NO: 134
  CH

SEQ ID NO: 436 - protein, 328 aa, Artificial Sequence; identical to SEQ ID NO: 135
  CH

SEQ ID NO: 437 - protein, 328 aa, Artificial Sequence; identical to SEQ ID NO: 136
  CH

SEQ ID NO: 438 - protein, 328 aa, Artificial Sequence; identical to SEQ ID NO: 137
  CH

SEQ ID NO: 439 - protein, 328 aa, Artificial Sequence; identical to SEQ ID NO: 138
  CH

SEQ ID NO: 440 - protein, 328 aa, Artificial Sequence; identical to SEQ ID NO: 139
  CH

SEQ ID NO: 441 - protein, 328 aa, Artificial Sequence; identical to SEQ ID NO: 140
  CH

SEQ ID NO: 442 - protein, 328 aa, Artificial Sequence; identical to SEQ ID NO: 141
  CH

SEQ ID NO: 443 - protein, 328 aa, Artificial Sequence; identical to SEQ ID NO: 142
  CH

SEQ ID NO: 444 - protein, 328 aa, Artificial Sequence; identical to SEQ ID NO: 143
  CH

SEQ ID NO: 445 - protein, 328 aa, Artificial Sequence; identical to SEQ ID NO: 144
  CH

SEQ ID NO: 446 - protein, 328 aa, Artificial Sequence; identical to SEQ ID NO: 145
  CH

SEQ ID NO: 447 - protein, 328 aa, Artificial Sequence; identical to SEQ ID NO: 146
  CH

SEQ ID NO: 448 - protein, 328 aa, Artificial Sequence; identical to SEQ ID NO: 147
  CH

SEQ ID NO: 449 - protein, 328 aa, Artificial Sequence; identical to SEQ ID NO: 148
  CH

SEQ ID NO: 450 - protein, 328 aa, Artificial Sequence; identical to SEQ ID NO: 149
  CH

SEQ ID NO: 451 - protein, 328 aa, Artificial Sequence; identical to SEQ ID NO: 150
  CH

SEQ ID NO: 452 - protein, 328 aa, Artificial Sequence; identical to SEQ ID NO: 151
  CH

SEQ ID NO: 453 - protein, 328 aa, Artificial Sequence; identical to SEQ ID NO: 152
  CH

SEQ ID NO: 454 - protein, 328 aa, Artificial Sequence; identical to SEQ ID NO: 153
  CH

SEQ ID NO: 455 - protein, 328 aa, Artificial Sequence; identical to SEQ ID NO: 154
  CH

SEQ ID NO: 456 - protein, 328 aa, Artificial Sequence; identical to SEQ ID NO: 155
  CH

SEQ ID NO: 457 - protein, 107 aa, Artificial Sequence; identical to SEQ ID NO: 156
  VL

SEQ ID NO: 458 - protein, 107 aa, Artificial Sequence; identical to SEQ ID NO: 157
  VL

SEQ ID NO: 459 - protein, 107 aa, Artificial Sequence; identical to SEQ ID NO: 158
  VL

SEQ ID NO: 460 - protein, 107 aa, Artificial Sequence; identical to SEQ ID NO: 159
  VL

SEQ ID NO: 461 - protein, 107 aa, Artificial Sequence; identical to SEQ ID NO: 160
  VL

SEQ ID NO: 462 - protein, 107 aa, Artificial Sequence; identical to SEQ ID NO: 161
  VL

SEQ ID NO: 463 - protein, 107 aa, Artificial Sequence; identical to SEQ ID NO: 162
  VL

SEQ ID NO: 464 - protein, 107 aa, Artificial Sequence; identical to SEQ ID NO: 163
  VL

SEQ ID NO: 465 - protein, 107 aa, Artificial Sequence; identical to SEQ ID NO: 164
  VL

SEQ ID NO: 466 - protein, 107 aa, Artificial Sequence; identical to SEQ ID NO: 165
  VL

SEQ ID NO: 467 - protein, 107 aa, Artificial Sequence; identical to SEQ ID NO: 166
  VL

SEQ ID NO: 468 - protein, 107 aa, Artificial Sequence; identical to SEQ ID NO: 167
  VL

SEQ ID NO: 469 - protein, 107 aa, Artificial Sequence; identical to SEQ ID NO: 168
  VL

SEQ ID NO: 470 - protein, 107 aa, Artificial Sequence; identical to SEQ ID NO: 169
  VL

SEQ ID NO: 471 - protein, 107 aa, Artificial Sequence; identical to SEQ ID NO: 170
  VL

SEQ ID NO: 472 - protein, 107 aa, Artificial Sequence; identical to SEQ ID NO: 171
  VL

SEQ ID NO: 473 - protein, 107 aa, Artificial Sequence; identical to SEQ ID NO: 172
  VL

SEQ ID NO: 474 - protein, 107 aa, Artificial Sequence; identical to SEQ ID NO: 173
  VL

SEQ ID NO: 475 - protein, 107 aa, Artificial Sequence; identical to SEQ ID NO: 204
  VL

SEQ ID NO: 476 - protein, 107 aa, Artificial Sequence; identical to SEQ ID NO: 205
  VL

SEQ ID NO: 477 - protein, 107 aa, Artificial Sequence; identical to SEQ ID NO: 206
  VL

SEQ ID NO: 478 - protein, 107 aa, Artificial Sequence; identical to SEQ ID NO: 207
  VL

SEQ ID NO: 479 - protein, 107 aa, Artificial Sequence; identical to SEQ ID NO: 208
  VL

SEQ ID NO: 480 - protein, 107 aa, Artificial Sequence; identical to SEQ ID NO: 209
  VL

SEQ ID NO: 481 - protein, 107 aa, Artificial Sequence; identical to SEQ ID NO: 210
  VL

SEQ ID NO: 482 - protein, 107 aa, Artificial Sequence; identical to SEQ ID NO: 211
  VL

SEQ ID NO: 483 - protein, 107 aa, Artificial Sequence; identical to SEQ ID NO: 212
  VL

SEQ ID NO: 484 - protein, 107 aa, Artificial Sequence; identical to SEQ ID NO: 213
  VL

SEQ ID NO: 485 - protein, 107 aa, Artificial Sequence; identical to SEQ ID NO: 174
  VL

SEQ ID NO: 486 - protein, 107 aa, Artificial Sequence; identical to SEQ ID NO: 175
  VL

SEQ ID NO: 487 - protein, 107 aa, Artificial Sequence; identical to SEQ ID NO: 176
  VL

SEQ ID NO: 488 - protein, 107 aa, Artificial Sequence; identical to SEQ ID NO: 177
  VL

SEQ ID NO: 489 - protein, 107 aa, Artificial Sequence; identical to SEQ ID NO: 178
  VL

SEQ ID NO: 490 - protein, 107 aa, Artificial Sequence; identical to SEQ ID NO: 179
  VL

SEQ ID NO: 491 - protein, 107 aa, Artificial Sequence; identical to SEQ ID NO: 180
  VL

SEQ ID NO: 492 - protein, 107 aa, Artificial Sequence; identical to SEQ ID NO: 181
  VL

SEQ ID NO: 493 - protein, 107 aa, Artificial Sequence; identical to SEQ ID NO: 182
  VL

SEQ ID NO: 494 - protein, 107 aa, Artificial Sequence; identical to SEQ ID NO: 183
  VL

SEQ ID NO: 495 - protein, 107 aa, Artificial Sequence; identical to SEQ ID NO: 184
  VL

SEQ ID NO: 496 - protein, 107 aa, Artificial Sequence; identical to SEQ ID NO: 185
  VL

SEQ ID NO: 497 - protein, 107 aa, Artificial Sequence; identical to SEQ ID NO: 186
  VL

SEQ ID NO: 498 - protein, 107 aa, Artificial Sequence; identical to SEQ ID NO: 187
  VL

SEQ ID NO: 499 - protein, 107 aa, Artificial Sequence; identical to SEQ ID NO: 188
  VL

SEQ ID NO: 500 - protein, 107 aa, Artificial Sequence; identical to SEQ ID NO: 189
  VL

SEQ ID NO: 501 - protein, 107 aa, Artificial Sequence; identical to SEQ ID NO: 190
  VL

SEQ ID NO: 502 - protein, 107 aa, Artificial Sequence; identical to SEQ ID NO: 191
  VL

SEQ ID NO: 503 - protein, 107 aa, Artificial Sequence; identical to SEQ ID NO: 192
  VL

SEQ ID NO: 504 - protein, 107 aa, Artificial Sequence; identical to SEQ ID NO: 193
  VL

SEQ ID NO: 505 - protein, 107 aa, Artificial Sequence; identical to SEQ ID NO: 214
  VL

SEQ ID NO: 506 - protein, 107 aa, Artificial Sequence; identical to SEQ ID NO: 215
  VL

SEQ ID NO: 507 - protein, 107 aa, Artificial Sequence; identical to SEQ ID NO: 194
  VL

SEQ ID NO: 508 - protein, 107 aa, Artificial Sequence; identical to SEQ ID NO: 195
  VL

SEQ ID NO: 509 - protein, 107 aa, Artificial Sequence; identical to SEQ ID NO: 196
  VL

SEQ ID NO: 510 - protein, 107 aa, Artificial Sequence; identical to SEQ ID NO: 197
  VL

SEQ ID NO: 511 - protein, 107 aa, Artificial Sequence; identical to SEQ ID NO: 198
  VL

SEQ ID NO: 512 - protein, 107 aa, Artificial Sequence; identical to SEQ ID NO: 199
  VL

SEQ ID NO: 513 - protein, 107 aa, Artificial Sequence; identical to SEQ ID NO: 200
  VL

SEQ ID NO: 514 - protein, 107 aa, Artificial Sequence; identical to SEQ ID NO: 201
  VL

SEQ ID NO: 515 - protein, 107 aa, Artificial Sequence; identical to SEQ ID NO: 202
  VL

SEQ ID NO: 516 - protein, 107 aa, Artificial Sequence; identical to SEQ ID NO: 203
  VL

SEQ ID NO: 517 - protein, 107 aa, Artificial Sequence; identical to SEQ ID NO: 216
  CL

SEQ ID NO: 518 - protein, 107 aa, Artificial Sequence; identical to SEQ ID NO: 217
  CL

SEQ ID NO: 519 - protein, 107 aa, Artificial Sequence; identical to SEQ ID NO: 218
  CL

SEQ ID NO: 520 - protein, 107 aa, Artificial Sequence; identical to SEQ ID NO: 219
  CL

SEQ ID NO: 521 - protein, 107 aa, Artificial Sequence; identical to SEQ ID NO: 220
  CL

SEQ ID NO: 522 - protein, 107 aa, Artificial Sequence; identical to SEQ ID NO: 221
  CL

SEQ ID NO: 523 - protein, 107 aa, Artificial Sequence; identical to SEQ ID NO: 222
  CL

SEQ ID NO: 524 - protein, 107 aa, Artificial Sequence; identical to SEQ ID NO: 223
  CL

SEQ ID NO: 525 - protein, 107 aa, Artificial Sequence; identical to SEQ ID NO: 224
  CL

SEQ ID NO: 526 - protein, 107 aa, Artificial Sequence; identical to SEQ ID NO: 225
  CL

SEQ ID NO: 527 - protein, 107 aa, Artificial Sequence; identical to SEQ ID NO: 226
  CL

SEQ ID NO: 528 - protein, 107 aa, Artificial Sequence; identical to SEQ ID NO: 227
  CL

SEQ ID NO: 529 - protein, 107 aa, Artificial Sequence; identical to SEQ ID NO: 228
  CL

SEQ ID NO: 530 - protein, 107 aa, Artificial Sequence; identical to SEQ ID NO: 229
  CL

SEQ ID NO: 531 - protein, 107 aa, Artificial Sequence; identical to SEQ ID NO: 230
  CL

SEQ ID NO: 532 - protein, 107 aa, Artificial Sequence; identical to SEQ ID NO: 231
  CL

SEQ ID NO: 533 - protein, 107 aa, Artificial Sequence; identical to SEQ ID NO: 232
  CL

SEQ ID NO: 534 - protein, 107 aa, Artificial Sequence; identical to SEQ ID NO: 233
  CL

SEQ ID NO: 535 - protein, 107 aa, Artificial Sequence; identical to SEQ ID NO: 234
  CL

SEQ ID NO: 536 - protein, 107 aa, Artificial Sequence; identical to SEQ ID NO: 235
  CL

SEQ ID NO: 537 - protein, 107 aa, Artificial Sequence; identical to SEQ ID NO: 236
  CL

SEQ ID NO: 538 - protein, 107 aa, Artificial Sequence; identical to SEQ ID NO: 237
  CL

SEQ ID NO: 539 - protein, 107 aa, Artificial Sequence; identical to SEQ ID NO: 238
  CL

SEQ ID NO: 540 - protein, 107 aa, Artificial Sequence; identical to SEQ ID NO: 239
  CL

SEQ ID NO: 541 - protein, 107 aa, Artificial Sequence; identical to SEQ ID NO: 240
  CL

SEQ ID NO: 542 - protein, 107 aa, Artificial Sequence; identical to SEQ ID NO: 241
  CL

SEQ ID NO: 543 - protein, 107 aa, Artificial Sequence; identical to SEQ ID NO: 242
  CL

SEQ ID NO: 544 - protein, 107 aa, Artificial Sequence; identical to SEQ ID NO: 243
  CL

SEQ ID NO: 545 - protein, 107 aa, Artificial Sequence; identical to SEQ ID NO: 244
  CL

SEQ ID NO: 546 - protein, 107 aa, Artificial Sequence; identical to SEQ ID NO: 245
  CL

SEQ ID NO: 547 - protein, 107 aa, Artificial Sequence; identical to SEQ ID NO: 246
  CL

SEQ ID NO: 548 - protein, 107 aa, Artificial Sequence; identical to SEQ ID NO: 247
  CL

SEQ ID NO: 549 - protein, 107 aa, Artificial Sequence; identical to SEQ ID NO: 248
  CL

SEQ ID NO: 550 - protein, 107 aa, Artificial Sequence; identical to SEQ ID NO: 249
  CL

SEQ ID NO: 551 - protein, 107 aa, Artificial Sequence; identical to SEQ ID NO: 250
  CL

SEQ ID NO: 552 - protein, 107 aa, Artificial Sequence; identical to SEQ ID NO: 251
  CL

SEQ ID NO: 553 - protein, 107 aa, Artificial Sequence; identical to SEQ ID NO: 252
  CL

SEQ ID NO: 554 - protein, 107 aa, Artificial Sequence; identical to SEQ ID NO: 253
  CL

SEQ ID NO: 555 - protein, 107 aa, Artificial Sequence; identical to SEQ ID NO: 254
  CL

SEQ ID NO: 556 - protein, 107 aa, Artificial Sequence; identical to SEQ ID NO: 255
  CL

SEQ ID NO: 557 - protein, 107 aa, Artificial Sequence; identical to SEQ ID NO: 256
  CL

SEQ ID NO: 558 - protein, 107 aa, Artificial Sequence; identical to SEQ ID NO: 257
  CL

SEQ ID NO: 559 - protein, 107 aa, Artificial Sequence; identical to SEQ ID NO: 258
  CL

SEQ ID NO: 560 - protein, 107 aa, Artificial Sequence; identical to SEQ ID NO: 259
  CL

SEQ ID NO: 561 - protein, 107 aa, Artificial Sequence; identical to SEQ ID NO: 260
  CL

SEQ ID NO: 562 - protein, 107 aa, Artificial Sequence; identical to SEQ ID NO: 261
  CL

SEQ ID NO: 563 - protein, 107 aa, Artificial Sequence; identical to SEQ ID NO: 262
  CL

SEQ ID NO: 564 - protein, 107 aa, Artificial Sequence; identical to SEQ ID NO: 263
  CL

SEQ ID NO: 565 - protein, 107 aa, Artificial Sequence; identical to SEQ ID NO: 264
  CL

SEQ ID NO: 566 - protein, 107 aa, Artificial Sequence; identical to SEQ ID NO: 265
  CL

SEQ ID NO: 567 - protein, 107 aa, Artificial Sequence; identical to SEQ ID NO: 266
  CL

SEQ ID NO: 568 - protein, 107 aa, Artificial Sequence; identical to SEQ ID NO: 267
  CL

SEQ ID NO: 569 - protein, 107 aa, Artificial Sequence; identical to SEQ ID NO: 268
  CL

SEQ ID NO: 570 - protein, 107 aa, Artificial Sequence; identical to SEQ ID NO: 269
  CL

SEQ ID NO: 571 - protein, 107 aa, Artificial Sequence; identical to SEQ ID NO: 270
  CL

SEQ ID NO: 572 - protein, 107 aa, Artificial Sequence; identical to SEQ ID NO: 271
  CL

SEQ ID NO: 573 - protein, 107 aa, Artificial Sequence; identical to SEQ ID NO: 272
  CL

SEQ ID NO: 574 - protein, 107 aa, Artificial Sequence; identical to SEQ ID NO: 273
  CL

SEQ ID NO: 575 - protein, 107 aa, Artificial Sequence; identical to SEQ ID NO: 274
  CL

SEQ ID NO: 576 - protein, 107 aa, Artificial Sequence; identical to SEQ ID NO: 275
  CL

SEQ ID NO: 577 - protein, 107 aa, Artificial Sequence; identical to SEQ ID NO: 276
  CL

SEQ ID NO: 578 - protein, 107 aa, Artificial Sequence; identical to SEQ ID NO: 277
  CL

SEQ ID NO: 579 - protein, 107 aa, Artificial Sequence; identical to SEQ ID NO: 278
  CL

SEQ ID NO: 580 - protein, 107 aa, Artificial Sequence; identical to SEQ ID NO: 279
  CL

SEQ ID NO: 581 - protein, 107 aa, Artificial Sequence; identical to SEQ ID NO: 280
  CL

SEQ ID NO: 582 - protein, 107 aa, Artificial Sequence; identical to SEQ ID NO: 281
  CL

SEQ ID NO: 583 - protein, 107 aa, Artificial Sequence; identical to SEQ ID NO: 282
  CL

SEQ ID NO: 584 - protein, 107 aa, Artificial Sequence; identical to SEQ ID NO: 283
  CL

SEQ ID NO: 585 - protein, 107 aa, Artificial Sequence; identical to SEQ ID NO: 284
  CL

SEQ ID NO: 586 - protein, 107 aa, Artificial Sequence; identical to SEQ ID NO: 285
  CL

SEQ ID NO: 587 - protein, 107 aa, Artificial Sequence; identical to SEQ ID NO: 286
  CL

SEQ ID NO: 588 - protein, 107 aa, Artificial Sequence; identical to SEQ ID NO: 287
  CL

SEQ ID NO: 589 - protein, 107 aa, Artificial Sequence; identical to SEQ ID NO: 288
  CL

SEQ ID NO: 590 - protein, 107 aa, Artificial Sequence; identical to SEQ ID NO: 289
  CL

SEQ ID NO: 591 - protein, 107 aa, Artificial Sequence; identical to SEQ ID NO: 290
  CL

SEQ ID NO: 592 - protein, 107 aa, Artificial Sequence; identical to SEQ ID NO: 291
  CL

SEQ ID NO: 593 - protein, 107 aa, Artificial Sequence; identical to SEQ ID NO: 292
  CL

SEQ ID NO: 594 - protein, 107 aa, Artificial Sequence; identical to SEQ ID NO: 293
  CL

SEQ ID NO: 595 - protein, 107 aa, Artificial Sequence; identical to SEQ ID NO: 294
  CL

SEQ ID NO: 596 - protein, 107 aa, Artificial Sequence; identical to SEQ ID NO: 295
  CL

SEQ ID NO: 597 - protein, 107 aa, Artificial Sequence; identical to SEQ ID NO: 296
  CL

SEQ ID NO: 598 - protein, 107 aa, Artificial Sequence; identical to SEQ ID NO: 297
  CL

SEQ ID NO: 599 - protein, 107 aa, Artificial Sequence; identical to SEQ ID NO: 298
  CL

SEQ ID NO: 600 - protein, 107 aa, Artificial Sequence; identical to SEQ ID NO: 299
  CL

SEQ ID NO: 601 - protein, 107 aa, Artificial Sequence; identical to SEQ ID NO: 300
  CL

SEQ ID NO: 602 - protein, 107 aa, Artificial Sequence; identical to SEQ ID NO: 301
  CL

SEQ ID NO: 603 - protein, 107 aa, Artificial Sequence; identical to SEQ ID NO: 302
  CL

SEQ ID NO: 604 - protein, 107 aa, Artificial Sequence; identical to SEQ ID NO: 303
  CL

SEQ ID NO: 605 - protein, 107 aa, Artificial Sequence; identical to SEQ ID NO: 304
  CL

SEQ ID NO: 606 - protein, 107 aa, Artificial Sequence; identical to SEQ ID NO: 305
  CL

SEQ ID NO: 607 - protein, 107 aa, Artificial Sequence; identical to SEQ ID NO: 306
  CL

SEQ ID NO: 608 - protein, 107 aa, Artificial Sequence; identical to SEQ ID NO: 307
  CL

SEQ ID NO: 609 - protein, 107 aa, Artificial Sequence; identical to SEQ ID NO: 308
  CL

SEQ ID NO: 610 - protein, 107 aa, Artificial Sequence; identical to SEQ ID NO: 309
  CL

SEQ ID NO: 611 - protein, 325 aa, Artificial Sequence
  CH
CSTKGPSVFPLAPCSRSTSESTAALGCLVKDYFPEPVTVSWNSGALTSGVHTFPAVLQSSGLYSLSSVVTVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 612 - protein, 325 aa, Artificial Sequence
  CH
ACTKGPSVFPLAPCSRSTSESTAALGCLVKDYFPEPVTVSWNSGALTSGVHTFPAVLQSSGLYSLSSVVTVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 613 - protein, 325 aa, Artificial Sequence
  CH
ASCKGPSVFPLAPCSRSTSESTAALGCLVKDYFPEPVTVSWNSGALTSGVHTFPAVLQSSGLYSLSSVVTVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 614 - protein, 325 aa, Artificial Sequence
  CH
ASTCGPSVFPLAPCSRSTSESTAALGCLVKDYFPEPVTVSWNSGALTSGVHTFPAVLQSSGLYSLSSVVTVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 615 - protein, 325 aa, Artificial Sequence
  CH
ASTKCPSVFPLAPCSRSTSESTAALGCLVKDYFPEPVTVSWNSGALTSGVHTFPAVLQSSGLYSLSSVVTVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 616 - protein, 325 aa, Artificial Sequence
  CH
ASTKGCSVFPLAPCSRSTSESTAALGCLVKDYFPEPVTVSWNSGALTSGVHTFPAVLQSSGLYSLSSVVTVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 617 - protein, 325 aa, Artificial Sequence
  CH
ASTKGPCVFPLAPCSRSTSESTAALGCLVKDYFPEPVTVSWNSGALTSGVHTFPAVLQSSGLYSLSSVVTVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 618 - protein, 325 aa, Artificial Sequence
  CH
ASTKGPSCFPLAPCSRSTSESTAALGCLVKDYFPEPVTVSWNSGALTSGVHTFPAVLQSSGLYSLSSVVTVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 619 - protein, 325 aa, Artificial Sequence
  CH
ASTKGPSVCPLAPCSRSTSESTAALGCLVKDYFPEPVTVSWNSGALTSGVHTFPAVLQSSGLYSLSSVVTVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 620 - protein, 325 aa, Artificial Sequence
  CH
ASTKGPSVFCLAPCSRSTSESTAALGCLVKDYFPEPVTVSWNSGALTSGVHTFPAVLQSSGLYSLSSVVTVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 621 - protein, 325 aa, Artificial Sequence
  CH
ASTKGPSVFPLAPCCRSTSESTAALGCLVKDYFPEPVTVSWNSGALTSGVHTFPAVLQSSGLYSLSSVVTVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 622 - protein, 325 aa, Artificial Sequence
  CH
ASTKGPSVFPLAPCSCSTSESTAALGCLVKDYFPEPVTVSWNSGALTSGVHTFPAVLQSSGLYSLSSVVTVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 623 - protein, 325 aa, Artificial Sequence
  CH
ASTKGPSVFPLAPCSRCTSESTAALGCLVKDYFPEPVTVSWNSGALTSGVHTFPAVLQSSGLYSLSSVVTVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 624 - protein, 325 aa, Artificial Sequence
  CH
ASTKGPSVFPLAPCSRSCSESTAALGCLVKDYFPEPVTVSWNSGALTSGVHTFPAVLQSSGLYSLSSVVTVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 625 - protein, 325 aa, Artificial Sequence
  CH
ASTKGPSVFPLAPCSRSTCESTAALGCLVKDYFPEPVTVSWNSGALTSGVHTFPAVLQSSGLYSLSSVVTVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 626 - protein, 325 aa, Artificial Sequence
  CH
ASTKGPSVFPLAPCSRSTSCSTAALGCLVKDYFPEPVTVSWNSGALTSGVHTFPAVLQSSGLYSLSSVVTVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 627 - protein, 325 aa, Artificial Sequence
  CH
ASTKGPSVFPLAPCSRSTSECTAALGCLVKDYFPEPVTVSWNSGALTSGVHTFPAVLQSSGLYSLSSVVTVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 628 - protein, 325 aa, Artificial Sequence
  CH
ASTKGPSVFPLAPCSRSTSESCAALGCLVKDYFPEPVTVSWNSGALTSGVHTFPAVLQSSGLYSLSSVVTVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 629 - protein, 325 aa, Artificial Sequence
  CH
ASTKGPSVFPLAPCSRSTSESTCALGCLVKDYFPEPVTVSWNSGALTSGVHTFPAVLQSSGLYSLSSVVTVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 630 - protein, 325 aa, Artificial Sequence
  CH
ASTKGPSVFPLAPCSRSTSESTACLGCLVKDYFPEPVTVSWNSGALTSGVHTFPAVLQSSGLYSLSSVVTVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 631 - protein, 325 aa, Artificial Sequence
  CH
ASTKGPSVFPLAPCSRSTSESTAALGCLVKCYFPEPVTVSWNSGALTSGVHTFPAVLQSSGLYSLSSVVTVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 632 - protein, 325 aa, Artificial Sequence
  CH
ASTKGPSVFPLAPCSRSTSESTAALGCLVKDCFPEPVTVSWNSGALTSGVHTFPAVLQSSGLYSLSSVVTVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 633 - protein, 325 aa, Artificial Sequence
  CH
ASTKGPSVFPLAPCSRSTSESTAALGCLVKDYCPEPVTVSWNSGALTSGVHTFPAVLQSSGLYSLSSVVTVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 634 - protein, 325 aa, Artificial Sequence
  CH
ASTKGPSVFPLAPCSRSTSESTAALGCLVKDYFCEPVTVSWNSGALTSGVHTFPAVLQSSGLYSLSSVVTVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 635 - protein, 325 aa, Artificial Sequence
  CH
ASTKGPSVFPLAPCSRSTSESTAALGCLVKDYFPCPVTVSWNSGALTSGVHTFPAVLQSSGLYSLSSVVTVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 636 - protein, 325 aa, Artificial Sequence
  CH
ASTKGPSVFPLAPCSRSTSESTAALGCLVKDYFPECVTVSWNSGALTSGVHTFPAVLQSSGLYSLSSVVTVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 637 - protein, 325 aa, Artificial Sequence
  CH
ASTKGPSVFPLAPCSRSTSESTAALGCLVKDYFPEPCTVSWNSGALTSGVHTFPAVLQSSGLYSLSSVVTVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 638 - protein, 325 aa, Artificial Sequence
  CH
ASTKGPSVFPLAPCSRSTSESTAALGCLVKDYFPEPVCVSWNSGALTSGVHTFPAVLQSSGLYSLSSVVTVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 639 - protein, 325 aa, Artificial Sequence
  CH
ASTKGPSVFPLAPCSRSTSESTAALGCLVKDYFPEPVTCSWNSGALTSGVHTFPAVLQSSGLYSLSSVVTVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 640 - protein, 325 aa, Artificial Sequence
  CH
ASTKGPSVFPLAPCSRSTSESTAALGCLVKDYFPEPVTVCWNSGALTSGVHTFPAVLQSSGLYSLSSVVTVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 641 - protein, 325 aa, Artificial Sequence
  CH
ASTKGPSVFPLAPCSRSTSESTAALGCLVKDYFPEPVTVSCNSGALTSGVHTFPAVLQSSGLYSLSSVVTVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 642 - protein, 325 aa, Artificial Sequence
  CH
ASTKGPSVFPLAPCSRSTSESTAALGCLVKDYFPEPVTVSWCSGALTSGVHTFPAVLQSSGLYSLSSVVTVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 643 - protein, 325 aa, Artificial Sequence
  CH
ASTKGPSVFPLAPCSRSTSESTAALGCLVKDYFPEPVTVSWNCGALTSGVHTFPAVLQSSGLYSLSSVVTVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 644 - protein, 325 aa, Artificial Sequence
  CH
ASTKGPSVFPLAPCSRSTSESTAALGCLVKDYFPEPVTVSWNSCALTSGVHTFPAVLQSSGLYSLSSVVTVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 645 - protein, 325 aa, Artificial Sequence
  CH
ASTKGPSVFPLAPCSRSTSESTAALGCLVKDYFPEPVTVSWNSGCLTSGVHTFPAVLQSSGLYSLSSVVTVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 646 - protein, 325 aa, Artificial Sequence
  CH
ASTKGPSVFPLAPCSRSTSESTAALGCLVKDYFPEPVTVSWNSGACTSGVHTFPAVLQSSGLYSLSSVVTVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 647 - protein, 325 aa, Artificial Sequence
  CH
ASTKGPSVFPLAPCSRSTSESTAALGCLVKDYFPEPVTVSWNSGALCSGVHTFPAVLQSSGLYSLSSVVTVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 648 - protein, 325 aa, Artificial Sequence
  CH
ASTKGPSVFPLAPCSRSTSESTAALGCLVKDYFPEPVTVSWNSGALTCGVHTFPAVLQSSGLYSLSSVVTVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 649 - protein, 325 aa, Artificial Sequence
  CH
ASTKGPSVFPLAPCSRSTSESTAALGCLVKDYFPEPVTVSWNSGALTSCVHTFPAVLQSSGLYSLSSVVTVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 650 - protein, 325 aa, Artificial Sequence
  CH
ASTKGPSVFPLAPCSRSTSESTAALGCLVKDYFPEPVTVSWNSGALTSGCHTFPAVLQSSGLYSLSSVVTVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 651 - protein, 325 aa, Artificial Sequence
  CH
ASTKGPSVFPLAPCSRSTSESTAALGCLVKDYFPEPVTVSWNSGALTSGVHTFPACLQSSGLYSLSSVVTVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 652 - protein, 325 aa, Artificial Sequence
  CH
ASTKGPSVFPLAPCSRSTSESTAALGCLVKDYFPEPVTVSWNSGALTSGVHTFPAVCQSSGLYSLSSVVTVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 653 - protein, 325 aa, Artificial Sequence
  CH
ASTKGPSVFPLAPCSRSTSESTAALGCLVKDYFPEPVTVSWNSGALTSGVHTFPAVLCSSGLYSLSSVVTVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 654 - protein, 325 aa, Artificial Sequence
  CH
ASTKGPSVFPLAPCSRSTSESTAALGCLVKDYFPEPVTVSWNSGALTSGVHTFPAVLQCSGLYSLSSVVTVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 655 - protein, 325 aa, Artificial Sequence
  CH
ASTKGPSVFPLAPCSRSTSESTAALGCLVKDYFPEPVTVSWNSGALTSGVHTFPAVLQSCGLYSLSSVVTVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 656 - protein, 325 aa, Artificial Sequence
  CH
ASTKGPSVFPLAPCSRSTSESTAALGCLVKDYFPEPVTVSWNSGALTSGVHTFPAVLQSSCLYSLSSVVTVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 657 - protein, 325 aa, Artificial Sequence
  CH
ASTKGPSVFPLAPCSRSTSESTAALGCLVKDYFPEPVTVSWNSGALTSGVHTFPAVLQSSGCYSLSSVVTVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 658 - protein, 325 aa, Artificial Sequence
  CH
ASTKGPSVFPLAPCSRSTSESTAALGCLVKDYFPEPVTVSWNSGALTSGVHTFPAVLQSSGLCSLSSVVTVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 659 - protein, 325 aa, Artificial Sequence
  CH
ASTKGPSVFPLAPCSRSTSESTAALGCLVKDYFPEPVTVSWNSGALTSGVHTFPAVLQSSGLYSLSSVCTVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 660 - protein, 325 aa, Artificial Sequence
  CH
ASTKGPSVFPLAPCSRSTSESTAALGCLVKDYFPEPVTVSWNSGALTSGVHTFPAVLQSSGLYSLSSVVCVPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 661 - protein, 325 aa, Artificial Sequence
  CH
ASTKGPSVFPLAPCSRSTSESTAALGCLVKDYFPEPVTVSWNSGALTSGVHTFPAVLQSSGLYSLSSVVTCPSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 662 - protein, 325 aa, Artificial Sequence
  CH
ASTKGPSVFPLAPCSRSTSESTAALGCLVKDYFPEPVTVSWNSGALTSGVHTFPAVLQSSGLYSLSSVVTVCSSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 663 - protein, 325 aa, Artificial Sequence
  CH
ASTKGPSVFPLAPCSRSTSESTAALGCLVKDYFPEPVTVSWNSGALTSGVHTFPAVLQSSGLYSLSSVVTVPCSSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 664 - protein, 325 aa, Artificial Sequence
  CH
ASTKGPSVFPLAPCSRSTSESTAALGCLVKDYFPEPVTVSWNSGALTSGVHTFPAVLQSSGLYSLSSVVTVPSCSLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 665 - protein, 325 aa, Artificial Sequence
  CH
ASTKGPSVFPLAPCSRSTSESTAALGCLVKDYFPEPVTVSWNSGALTSGVHTFPAVLQSSGLYSLSSVVTVPSSCLGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 666 - protein, 325 aa, Artificial Sequence
  CH
ASTKGPSVFPLAPCSRSTSESTAALGCLVKDYFPEPVTVSWNSGALTSGVHTFPAVLQSSGLYSLSSVVTVPSSSCGTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 667 - protein, 325 aa, Artificial Sequence
  CH
ASTKGPSVFPLAPCSRSTSESTAALGCLVKDYFPEPVTVSWNSGALTSGVHTFPAVLQSSGLYSLSSVVTVPSSSLCTQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 668 - protein, 325 aa, Artificial Sequence
  CH
ASTKGPSVFPLAPCSRSTSESTAALGCLVKDYFPEPVTVSWNSGALTSGVHTFPAVLQSSGLYSLSSVVTVPSSSLGCQTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 669 - protein, 325 aa, Artificial Sequence
  CH
ASTKGPSVFPLAPCSRSTSESTAALGCLVKDYFPEPVTVSWNSGALTSGVHTFPAVLQSSGLYSLSSVVTVPSSSLGTCTYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 670 - protein, 325 aa, Artificial Sequence
  CH
ASTKGPSVFPLAPCSRSTSESTAALGCLVKDYFPEPVTVSWNSGALTSGVHTFPAVLQSSGLYSLSSVVTVPSSSLGTQCYTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 671 - protein, 325 aa, Artificial Sequence
  CH
ASTKGPSVFPLAPCSRSTSESTAALGCLVKDYFPEPVTVSWNSGALTSGVHTFPAVLQSSGLYSLSSVVTVPSSSLGTQTCTCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 672 - protein, 325 aa, Artificial Sequence
  CH
ASTKGPSVFPLAPCSRSTSESTAALGCLVKDYFPEPVTVSWNSGALTSGVHTFPAVLQSSGLYSLSSVVTVPSSSLGTQTYCCNVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 673 - protein, 325 aa, Artificial Sequence
  CH
ASTKGPSVFPLAPCSRSTSESTAALGCLVKDYFPEPVTVSWNSGALTSGVHTFPAVLQSSGLYSLSSVVTVPSSSLGTQTYTCCVDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 674 - protein, 325 aa, Artificial Sequence
  CH
ASTKGPSVFPLAPCSRSTSESTAALGCLVKDYFPEPVTVSWNSGALTSGVHTFPAVLQSSGLYSLSSVVTVPSSSLGTQTYTCNCDHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 675 - protein, 325 aa, Artificial Sequence
  CH
ASTKGPSVFPLAPCSRSTSESTAALGCLVKDYFPEPVTVSWNSGALTSGVHTFPAVLQSSGLYSLSSVVTVPSSSLGTQTYTCNVCHKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 676 - protein, 325 aa, Artificial Sequence
  CH
ASTKGPSVFPLAPCSRSTSESTAALGCLVKDYFPEPVTVSWNSGALTSGVHTFPAVLQSSGLYSLSSVVTVPSSSLGTQTYTCNVDCKPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 677 - protein, 325 aa, Artificial Sequence
  CH
ASTKGPSVFPLAPCSRSTSESTAALGCLVKDYFPEPVTVSWNSGALTSGVHTFPAVLQSSGLYSLSSVVTVPSSSLGTQTYTCNVDHCPSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 678 - protein, 325 aa, Artificial Sequence
  CH
ASTKGPSVFPLAPCSRSTSESTAALGCLVKDYFPEPVTVSWNSGALTSGVHTFPAVLQSSGLYSLSSVVTVPSSSLGTQTYTCNVDHKCSNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 679 - protein, 325 aa, Artificial Sequence
  CH
ASTKGPSVFPLAPCSRSTSESTAALGCLVKDYFPEPVTVSWNSGALTSGVHTFPAVLQSSGLYSLSSVVTVPSSSLGTQTYTCNVDHKPCNTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 680 - protein, 325 aa, Artificial Sequence
  CH
ASTKGPSVFPLAPCSRSTSESTAALGCLVKDYFPEPVTVSWNSGALTSGVHTFPAVLQSSGLYSLSSVVTVPSSSLGTQTYTCNVDHKPSCTKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 681 - protein, 325 aa, Artificial Sequence
  CH
ASTKGPSVFPLAPCSRSTSESTAALGCLVKDYFPEPVTVSWNSGALTSGVHTFPAVLQSSGLYSLSSVVTVPSSSLGTQTYTCNVDHKPSNCKVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 682 - protein, 325 aa, Artificial Sequence
  CH
ASTKGPSVFPLAPCSRSTSESTAALGCLVKDYFPEPVTVSWNSGALTSGVHTFPAVLQSSGLYSLSSVVTVPSSSLGTQTYTCNVDHKPSNTCVDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 683 - protein, 325 aa, Artificial Sequence
  CH
ASTKGPSVFPLAPCSRSTSESTAALGCLVKDYFPEPVTVSWNSGALTSGVHTFPAVLQSSGLYSLSSVVTVPSSSLGTQTYTCNVDHKPSNTKCDKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 684 - protein, 325 aa, Artificial Sequence
  CH
ASTKGPSVFPLAPCSRSTSESTAALGCLVKDYFPEPVTVSWNSGALTSGVHTFPAVLQSSGLYSLSSVVTVPSSSLGTQTYTCNVDHKPSNTKVCKRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 685 - protein, 325 aa, Artificial Sequence
  CH
ASTKGPSVFPLAPCSRSTSESTAALGCLVKDYFPEPVTVSWNSGALTSGVHTFPAVLQSSGLYSLSSVVTVPSSSLGTQTYTCNVDHKPSNTKVDCRVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 686 - protein, 325 aa, Artificial Sequence
  CH
ASTKGPSVFPLAPCSRSTSESTAALGCLVKDYFPEPVTVSWNSGALTSGVHTFPAVLQSSGLYSLSSVVTVPSSSLGTQTYTCNVDHKPSNTKVDKCVESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 687 - protein, 325 aa, Artificial Sequence
  CH
ASTKGPSVFPLAPCSRSTSESTAALGCLVKDYFPEPVTVSWNSGALTSGVHTFPAVLQSSGLYSLSSVVTVPSSSLGTQTYTCNVDHKPSNTKVDKRCESKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 688 - protein, 325 aa, Artificial Sequence
  CH
ASTKGPSVFPLAPCSRSTSESTAALGCLVKDYFPEPVTVSWNSGALTSGVHTFPAVLQSSGLYSLSSVVTVPSSSLGTQTYTCNVDHKPSNTKVDKRVCSKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 689 - protein, 325 aa, Artificial Sequence
  CH
ASTKGPSVFPLAPCSRSTSESTAALGCLVKDYFPEPVTVSWNSGALTSGVHTFPAVLQSSGLYSLSSVVTVPSSSLGTQTYTCNVDHKPSNTKVDKRVECKYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 690 - protein, 325 aa, Artificial Sequence
  CH
ASTKGPSVFPLAPCSRSTSESTAALGCLVKDYFPEPVTVSWNSGALTSGVHTFPAVLQSSGLYSLSSVVTVPSSSLGTQTYTCNVDHKPSNTKVDKRVESCYGPPCPPCPAPEFRRGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 691 - protein, 324 aa, Artificial Sequence
  CH
CSTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 692 - protein, 324 aa, Artificial Sequence
  CH
ACTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 693 - protein, 324 aa, Artificial Sequence
  CH
ASCKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 694 - protein, 324 aa, Artificial Sequence
  CH
ASTCGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 695 - protein, 324 aa, Artificial Sequence
  CH
ASTKCPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 696 - protein, 324 aa, Artificial Sequence
  CH
ASTKGCSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 697 - protein, 324 aa, Artificial Sequence
  CH
ASTKGPCVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 698 - protein, 324 aa, Artificial Sequence
  CH
ASTKGPSCFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 699 - protein, 324 aa, Artificial Sequence
  CH
ASTKGPSVCPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 700 - protein, 324 aa, Artificial Sequence
  CH
ASTKGPSVFCLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 701 - protein, 324 aa, Artificial Sequence
  CH
ASTKGPSVFPLAPCCRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 702 - protein, 324 aa, Artificial Sequence
  CH
ASTKGPSVFPLAPCSCSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 703 - protein, 324 aa, Artificial Sequence
  CH
ASTKGPSVFPLAPCSRCTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 704 - protein, 324 aa, Artificial Sequence
  CH
ASTKGPSVFPLAPCSRSCSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 705 - protein, 324 aa, Artificial Sequence
  CH
ASTKGPSVFPLAPCSRSTCESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 706 - protein, 324 aa, Artificial Sequence
  CH
ASTKGPSVFPLAPCSRSTSCSTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 707 - protein, 324 aa, Artificial Sequence
  CH
ASTKGPSVFPLAPCSRSTSECTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 708 - protein, 324 aa, Artificial Sequence
  CH
ASTKGPSVFPLAPCSRSTSESCAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 709 - protein, 324 aa, Artificial Sequence
  CH
ASTKGPSVFPLAPCSRSTSESTCALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 710 - protein, 324 aa, Artificial Sequence
  CH
ASTKGPSVFPLAPCSRSTSESTACLGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 711 - protein, 324 aa, Artificial Sequence
  CH
ASTKGPSVFPLAPCSRSTSESTAALGCLVKCYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 712 - protein, 324 aa, Artificial Sequence
  CH
ASTKGPSVFPLAPCSRSTSESTAALGCLVKDCFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 713 - protein, 324 aa, Artificial Sequence
  CH
ASTKGPSVFPLAPCSRSTSESTAALGCLVKDYCPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 714 - protein, 324 aa, Artificial Sequence
  CH
ASTKGPSVFPLAPCSRSTSESTAALGCLVKDYFCEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 715 - protein, 324 aa, Artificial Sequence
  CH
ASTKGPSVFPLAPCSRSTSESTAALGCLVKDYFPCPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 716 - protein, 324 aa, Artificial Sequence
  CH
ASTKGPSVFPLAPCSRSTSESTAALGCLVKDYFPECVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 717 - protein, 324 aa, Artificial Sequence
  CH
ASTKGPSVFPLAPCSRSTSESTAALGCLVKDYFPEPCTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 718 - protein, 324 aa, Artificial Sequence
  CH
ASTKGPSVFPLAPCSRSTSESTAALGCLVKDYFPEPVCVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 719 - protein, 324 aa, Artificial Sequence
  CH
ASTKGPSVFPLAPCSRSTSESTAALGCLVKDYFPEPVTCSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 720 - protein, 324 aa, Artificial Sequence
  CH
ASTKGPSVFPLAPCSRSTSESTAALGCLVKDYFPEPVTVCWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 721 - protein, 324 aa, Artificial Sequence
  CH
ASTKGPSVFPLAPCSRSTSESTAALGCLVKDYFPEPVTVSCNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 722 - protein, 324 aa, Artificial Sequence
  CH
ASTKGPSVFPLAPCSRSTSESTAALGCLVKDYFPEPVTVSWCSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 723 - protein, 324 aa, Artificial Sequence
  CH
ASTKGPSVFPLAPCSRSTSESTAALGCLVKDYFPEPVTVSWNCGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 724 - protein, 324 aa, Artificial Sequence
  CH
ASTKGPSVFPLAPCSRSTSESTAALGCLVKDYFPEPVTVSWNSCALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 725 - protein, 324 aa, Artificial Sequence
  CH
ASTKGPSVFPLAPCSRSTSESTAALGCLVKDYFPEPVTVSWNSGCLTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 726 - protein, 324 aa, Artificial Sequence
  CH
ASTKGPSVFPLAPCSRSTSESTAALGCLVKDYFPEPVTVSWNSGACTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 727 - protein, 324 aa, Artificial Sequence
  CH
ASTKGPSVFPLAPCSRSTSESTAALGCLVKDYFPEPVTVSWNSGALCSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 728 - protein, 324 aa, Artificial Sequence
  CH
ASTKGPSVFPLAPCSRSTSESTAALGCLVKDYFPEPVTVSWNSGALTCGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 729 - protein, 324 aa, Artificial Sequence
  CH
ASTKGPSVFPLAPCSRSTSESTAALGCLVKDYFPEPVTVSWNSGALTSCVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 730 - protein, 324 aa, Artificial Sequence
  CH
ASTKGPSVFPLAPCSRSTSESTAALGCLVKDYFPEPVTVSWNSGALTSGCHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 731 - protein, 324 aa, Artificial Sequence
  CH
ASTKGPSVFPLAPCSRSTSESTAALGCLVKDYFPEPVTVSWNSGALTSGVHTFPACLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 732 - protein, 324 aa, Artificial Sequence
  CH
ASTKGPSVFPLAPCSRSTSESTAALGCLVKDYFPEPVTVSWNSGALTSGVHTFPAVCQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 733 - protein, 324 aa, Artificial Sequence
  CH
ASTKGPSVFPLAPCSRSTSESTAALGCLVKDYFPEPVTVSWNSGALTSGVHTFPAVLCSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 734 - protein, 324 aa, Artificial Sequence
  CH
ASTKGPSVFPLAPCSRSTSESTAALGCLVKDYFPEPVTVSWNSGALTSGVHTFPAVLQCSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 735 - protein, 324 aa, Artificial Sequence
  CH
ASTKGPSVFPLAPCSRSTSESTAALGCLVKDYFPEPVTVSWNSGALTSGVHTFPAVLQSCGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 736 - protein, 324 aa, Artificial Sequence
  CH
ASTKGPSVFPLAPCSRSTSESTAALGCLVKDYFPEPVTVSWNSGALTSGVHTFPAVLQSSCLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 737 - protein, 324 aa, Artificial Sequence
  CH
ASTKGPSVFPLAPCSRSTSESTAALGCLVKDYFPEPVTVSWNSGALTSGVHTFPAVLQSSGCYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 738 - protein, 324 aa, Artificial Sequence
  CH
ASTKGPSVFPLAPCSRSTSESTAALGCLVKDYFPEPVTVSWNSGALTSGVHTFPAVLQSSGLCSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 739 - protein, 324 aa, Artificial Sequence
  CH
ASTKGPSVFPLAPCSRSTSESTAALGCLVKDYFPEPVTVSWNSGALTSGVHTFPAVLQSSGLYSLSSVCTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 740 - protein, 324 aa, Artificial Sequence
  CH
ASTKGPSVFPLAPCSRSTSESTAALGCLVKDYFPEPVTVSWNSGALTSGVHTFPAVLQSSGLYSLSSVVCVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 741 - protein, 324 aa, Artificial Sequence
  CH
ASTKGPSVFPLAPCSRSTSESTAALGCLVKDYFPEPVTVSWNSGALTSGVHTFPAVLQSSGLYSLSSVVTCPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 742 - protein, 324 aa, Artificial Sequence
  CH
ASTKGPSVFPLAPCSRSTSESTAALGCLVKDYFPEPVTVSWNSGALTSGVHTFPAVLQSSGLYSLSSVVTVCSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 743 - protein, 324 aa, Artificial Sequence
  CH
ASTKGPSVFPLAPCSRSTSESTAALGCLVKDYFPEPVTVSWNSGALTSGVHTFPAVLQSSGLYSLSSVVTVPCSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 744 - protein, 324 aa, Artificial Sequence
  CH
ASTKGPSVFPLAPCSRSTSESTAALGCLVKDYFPEPVTVSWNSGALTSGVHTFPAVLQSSGLYSLSSVVTVPSCNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 745 - protein, 324 aa, Artificial Sequence
  CH
ASTKGPSVFPLAPCSRSTSESTAALGCLVKDYFPEPVTVSWNSGALTSGVHTFPAVLQSSGLYSLSSVVTVPSSCFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 746 - protein, 324 aa, Artificial Sequence
  CH
ASTKGPSVFPLAPCSRSTSESTAALGCLVKDYFPEPVTVSWNSGALTSGVHTFPAVLQSSGLYSLSSVVTVPSSNCGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 747 - protein, 324 aa, Artificial Sequence
  CH
ASTKGPSVFPLAPCSRSTSESTAALGCLVKDYFPEPVTVSWNSGALTSGVHTFPAVLQSSGLYSLSSVVTVPSSNFCTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 748 - protein, 324 aa, Artificial Sequence
  CH
ASTKGPSVFPLAPCSRSTSESTAALGCLVKDYFPEPVTVSWNSGALTSGVHTFPAVLQSSGLYSLSSVVTVPSSNFGCQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 749 - protein, 324 aa, Artificial Sequence
  CH
ASTKGPSVFPLAPCSRSTSESTAALGCLVKDYFPEPVTVSWNSGALTSGVHTFPAVLQSSGLYSLSSVVTVPSSNFGTCTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 750 - protein, 324 aa, Artificial Sequence
  CH
ASTKGPSVFPLAPCSRSTSESTAALGCLVKDYFPEPVTVSWNSGALTSGVHTFPAVLQSSGLYSLSSVVTVPSSNFGTQCYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 751 - protein, 324 aa, Artificial Sequence
  CH
ASTKGPSVFPLAPCSRSTSESTAALGCLVKDYFPEPVTVSWNSGALTSGVHTFPAVLQSSGLYSLSSVVTVPSSNFGTQTCTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 752 - protein, 324 aa, Artificial Sequence
  CH
ASTKGPSVFPLAPCSRSTSESTAALGCLVKDYFPEPVTVSWNSGALTSGVHTFPAVLQSSGLYSLSSVVTVPSSNFGTQTYCCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 753 - protein, 324 aa, Artificial Sequence
  CH
ASTKGPSVFPLAPCSRSTSESTAALGCLVKDYFPEPVTVSWNSGALTSGVHTFPAVLQSSGLYSLSSVVTVPSSNFGTQTYTCCVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 754 - protein, 324 aa, Artificial Sequence
  CH
ASTKGPSVFPLAPCSRSTSESTAALGCLVKDYFPEPVTVSWNSGALTSGVHTFPAVLQSSGLYSLSSVVTVPSSNFGTQTYTCNCDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 755 - protein, 324 aa, Artificial Sequence
  CH
ASTKGPSVFPLAPCSRSTSESTAALGCLVKDYFPEPVTVSWNSGALTSGVHTFPAVLQSSGLYSLSSVVTVPSSNFGTQTYTCNVCHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 756 - protein, 324 aa, Artificial Sequence
  CH
ASTKGPSVFPLAPCSRSTSESTAALGCLVKDYFPEPVTVSWNSGALTSGVHTFPAVLQSSGLYSLSSVVTVPSSNFGTQTYTCNVDCKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 757 - protein, 324 aa, Artificial Sequence
  CH
ASTKGPSVFPLAPCSRSTSESTAALGCLVKDYFPEPVTVSWNSGALTSGVHTFPAVLQSSGLYSLSSVVTVPSSNFGTQTYTCNVDHCPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 758 - protein, 324 aa, Artificial Sequence
  CH
ASTKGPSVFPLAPCSRSTSESTAALGCLVKDYFPEPVTVSWNSGALTSGVHTFPAVLQSSGLYSLSSVVTVPSSNFGTQTYTCNVDHKCSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 759 - protein, 324 aa, Artificial Sequence
  CH
ASTKGPSVFPLAPCSRSTSESTAALGCLVKDYFPEPVTVSWNSGALTSGVHTFPAVLQSSGLYSLSSVVTVPSSNFGTQTYTCNVDHKPCNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 760 - protein, 324 aa, Artificial Sequence
  CH
ASTKGPSVFPLAPCSRSTSESTAALGCLVKDYFPEPVTVSWNSGALTSGVHTFPAVLQSSGLYSLSSVVTVPSSNFGTQTYTCNVDHKPSCTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 761 - protein, 324 aa, Artificial Sequence
  CH
ASTKGPSVFPLAPCSRSTSESTAALGCLVKDYFPEPVTVSWNSGALTSGVHTFPAVLQSSGLYSLSSVVTVPSSNFGTQTYTCNVDHKPSNCKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 762 - protein, 324 aa, Artificial Sequence
  CH
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTCVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 763 - protein, 324 aa, Artificial Sequence
  CH
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKCDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 764 - protein, 324 aa, Artificial Sequence
  CH
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVCKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 765 - protein, 324 aa, Artificial Sequence
  CH
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDCTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 766 - protein, 324 aa, Artificial Sequence
  CH
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKCVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 767 - protein, 324 aa, Artificial Sequence
  CH
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTCERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 768 - protein, 324 aa, Artificial Sequence
  CH
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVCRKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 769 - protein, 324 aa, Artificial Sequence
  CH
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVECKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 770 - protein, 324 aa, Artificial Sequence
  CH
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERCCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSP

SEQ ID NO: 771 - protein, 110 aa, Artificial Sequence
  VL
QSVLCQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVL

SEQ ID NO: 772 - protein, 110 aa, Artificial Sequence
  VL
QSVLTCPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVL

SEQ ID NO: 773 - protein, 110 aa, Artificial Sequence
  VL
QSVLTQCPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVL

SEQ ID NO: 774 - protein, 110 aa, Artificial Sequence
  VL
QSVLTQPCSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVL

SEQ ID NO: 775 - protein, 110 aa, Artificial Sequence
  VL
QSVLTQPPCASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVL

SEQ ID NO: 776 - protein, 110 aa, Artificial Sequence
  VL
QSVLTQPPSCSGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVL

SEQ ID NO: 777 - protein, 110 aa, Artificial Sequence
  VL
QSVLTQPPSACGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVL

SEQ ID NO: 778 - protein, 110 aa, Artificial Sequence
  VL
QSVLTQPPSASCTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVL

SEQ ID NO: 779 - protein, 110 aa, Artificial Sequence
  VL
QSVLTQPPSASGCPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVL

SEQ ID NO: 780 - protein, 110 aa, Artificial Sequence
  VL
QSVLTQPPSASGTCGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVL

SEQ ID NO: 781 - protein, 110 aa, Artificial Sequence
  VL
QSVLTQPPSASGTPCQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVL

SEQ ID NO: 782 - protein, 110 aa, Artificial Sequence
  VL
QSVLTQPPSASGTPGCRVTISCSGSSSNIGSNTVNWYQRLPGAAPQLLIYNNDQRPSGIPDRFSGSKSGTSGSLVISGLQSEDEADYYCASWDDSLNGRVFGGGTKLTVL

SEQ ID NO: 783 - protein, 110 aa, Artificial Sequence
  VL
QSVLTQPPSASGTPGQCVTISCSGSSSNIGSNTVNWYQRLPGAAPQLLIYNNDQRPSGIPDRFSGSKSGTSGSLVISGLQSEDEADYYCASWDDSLNGRVFGGGTKLTVL

SEQ ID NO: 784 - protein, 110 aa, Artificial Sequence
  VL
QSVLTQPPSASGTPGQRCTISCSGSSSNIGSNTVNWYQRLPGAAPQLLIYNNDQRPSGIPDRFSGSKSGTSGSLVISGLQSEDEADYYCASWDDSLNGRVFGGGTKLTVL

SEQ ID NO: 785 - protein, 110 aa, Artificial Sequence
  VL
QSVLTQPPSASGTPGQRVCISCSGSSSNIGSNTVNWYQRLPGAAPQLLIYNNDQRPSGIPDRFSGSKSGTSGSLVISGLQSEDEADYYCASWDDSLNGRVFGGGTKLTVL

SEQ ID NO: 786 - protein, 110 aa, Artificial Sequence
  VL
QSVLTQPPSASGTPGQRVTCSCSGSSSNIGSNTVNWYQRLPGAAPQLLIYNNDQRPSGIPDRFSGSKSGTSGSLVISGLQSEDEADYYCASWDDSLNGRVFGGGTKLTVL

SEQ ID NO: 787 - protein, 110 aa, Artificial Sequence
  VL
QSVLTQPPSASGTPGQRVTICCSGSSSNIGSNTVNWYQRLPGAAPQLLIYNNDQRPSGIPDRFSGSKSGTSGSLVISGLQSEDEADYYCASWDDSLNGRVFGGGTKLTVL

SEQ ID NO: 788 - protein, 110 aa, Artificial Sequence
  VL
QSVLTQPPSASGTPGQRVTISCSCSSSNIGSNTVNWYQRLPGAAPQLLIYNNDQRPSGIPDRFSGSKSGTSGSLVISGLQSEDEADYYCASWDDSLNGRVFGGGTKLTVL

SEQ ID NO: 789 - protein, 110 aa, Artificial Sequence
  VL
QSVLTQPPSASGTPGQRVTISCSGCSSNIGSNTVNWYQRLPGAAPQLLIYNNDQRPSGIPDRFSGSKSGTSGSLVISGLQSEDEADYYCASWDDSLNGRVFGGGTKLTVL

SEQ ID NO: 790 - protein, 110 aa, Artificial Sequence
  VL
QSVLTQPPSASGTPGQRVTISCSGSCSNIGSNTVNWYQRLPGAAPQLLIYNNDQRPSGIPDRFSGSKSGTSGSLVISGLQSEDEADYYCASWDDSLNGRVFGGGTKLTVL

SEQ ID NO: 791 - protein, 110 aa, Artificial Sequence
  VL
QSVLTQPPSASGTPGQRVTISCSGSSCNIGSNTVNWYQRLPGAAPQLLIYNNDQRPSGIPDRFSGSKSGTSGSLVISGLQSEDEADYYCASWDDSLNGRVFGGGTKLTVL

SEQ ID NO: 792 - protein, 110 aa, Artificial Sequence
  VL
QSVLTQPPSASGTPGQRVTISCSGSSSNIGSNCVNWYQRLPGAAPQLLIYNNDQRPSGIPDRFSGSKSGTSGSLVISGLQSEDEADYYCASWDDSLNGRVFGGGTKLTVL

SEQ ID NO: 793 - protein, 110 aa, Artificial Sequence
  VL
QSVLTQPPSASGTPGQRVTISCSGSSSNIGSNTCNWYQRLPGAAPQLLIYNNDQRPSGIPDRFSGSKSGTSGSLVISGLQSEDEADYYCASWDDSLNGRVFGGGTKLTVL

SEQ ID NO: 794 - protein, 110 aa, Artificial Sequence
  VL
QSVLTQPPSASGTPGQRVTISCSGSSSNIGSNTVCWYQRLPGAAPQLLIYNNDQRPSGIPDRFSGSKSGTSGSLVISGLQSEDEADYYCASWDDSLNGRVFGGGTKLTVL

SEQ ID NO: 795 - protein, 110 aa, Artificial Sequence
  VL
QSVLTQPPSASGTPGQRVTISCSGSSSNIGSNTVNWYQRLPGAAPQLLIYCNDQRPSGIPDRFSGSKSGTSGSLVISGLQSEDEADYYCASWDDSLNGRVFGGGTKLTVL

SEQ ID NO: 796 - protein, 110 aa, Artificial Sequence
  VL
QSVLTQPPSASGTPGQRVTISCSGSSSNIGSNTVNWYQRLPGAAPQLLIYNCDQRPSGIPDRFSGSKSGTSGSLVISGLQSEDEADYYCASWDDSLNGRVFGGGTKLTVL

SEQ ID NO: 797 - protein, 110 aa, Artificial Sequence
  VL
QSVLTQPPSASGTPGQRVTISCSGSSSNIGSNTVNWYQRLPGAAPQLLIYNNDQRCSGIPDRFSGSKSGTSGSLVISGLQSEDEADYYCASWDDSLNGRVFGGGTKLTVL

SEQ ID NO: 798 - protein, 110 aa, Artificial Sequence
  VL
QSVLTQPPSASGTPGQRVTISCSGSSSNIGSNTVNWYQRLPGAAPQLLIYNNDQRPCGIPDRFSGSKSGTSGSLVISGLQSEDEADYYCASWDDSLNGRVFGGGTKLTVL

SEQ ID NO: 799 - protein, 110 aa, Artificial Sequence
  VL
QSVLTQPPSASGTPGQRVTISCSGSSSNIGSNTVNWYQRLPGAAPQLLIYNNDQRPSCIPDRFSGSKSGTSGSLVISGLQSEDEADYYCASWDDSLNGRVFGGGTKLTVL

SEQ ID NO: 800 - protein, 110 aa, Artificial Sequence
  VL
QSVLTQPPSASGTPGQRVTISCSGSSSNIGSNTVNWYQRLPGAAPQLLIYNNDQRPSGCPDRFSGSKSGTSGSLVISGLQSEDEADYYCASWDDSLNGRVFGGGTKLTVL

SEQ ID NO: 801 - protein, 110 aa, Artificial Sequence
  VL
QSVLTQPPSASGTPGQRVTISCSGSSSNIGSNTVNWYQRLPGAAPQLLIYNNDQRPSGICDRFSGSKSGTSGSLVISGLQSEDEADYYCASWDDSLNGRVFGGGTKLTVL

SEQ ID NO: 802 - protein, 110 aa, Artificial Sequence
  VL
QSVLTQPPSASGTPGQRVTISCSGSSSNIGSNTVNWYQRLPGAAPQLLIYNNDQRPSGIPCRFSGSKSGTSGSLVISGLQSEDEADYYCASWDDSLNGRVFGGGTKLTVL

SEQ ID NO: 803 - protein, 110 aa, Artificial Sequence
  VL
QSVLTQPPSASGTPGQRVTISCSGSSSNIGSNTVNWYQRLPGAAPQLLIYNNDQRPSGIPDCFSGSKSGTSGSLVISGLQSEDEADYYCASWDDSLNGRVFGGGTKLTVL

SEQ ID NO: 804 - protein, 110 aa, Artificial Sequence
  VL
QSVLTQPPSASGTPGQRVTISCSGSSSNIGSNTVNWYQRLPGAAPQLLIYNNDQRPSGIPDRCSGSKSGTSGSLVISGLQSEDEADYYCASWDDSLNGRVFGGGTKLTVL

SEQ ID NO: 805 - protein, 110 aa, Artificial Sequence
  VL
QSVLTQPPSASGTPGQRVTISCSGSSSNIGSNTVNWYQRLPGAAPQLLIYNNDQRPSGIPDRFCGSKSGTSGSLVISGLQSEDEADYYCASWDDSLNGRVFGGGTKLTVL

SEQ ID NO: 806 - protein, 110 aa, Artificial Sequence
  VL
QSVLTQPPSASGTPGQRVTISCSGSSSNIGSNTVNWYQRLPGAAPQLLIYNNDQRPSGIPDRFSGCKSGTSGSLVISGLQSEDEADYYCASWDDSLNGRVFGGGTKLTVL

SEQ ID NO: 807 - protein, 110 aa, Artificial Sequence
  VL
QSVLTQPPSASGTPGQRVTISCSGSSSNIGSNTVNWYQRLPGAAPQLLIYNNDQRPSGIPDRFSGSKCGTSGSLVISGLQSEDEADYYCASWDDSLNGRVFGGGTKLTVL

SEQ ID NO: 808 - protein, 110 aa, Artificial Sequence
  VL
QSVLTQPPSASGTPGQRVTISCSGSSSNIGSNTVNWYQRLPGAAPQLLIYNNDQRPSGIPDRFSGSKSCTSGSLVISGLQSEDEADYYCASWDDSLNGRVFGGGTKLTVL

SEQ ID NO: 809 - protein, 110 aa, Artificial Sequence
  VL
QSVLTQPPSASGTPGQRVTISCSGSSSNIGSNTVNWYQRLPGAAPQLLIYNNDQRPSGIPDRFSGSKSGCSGSLVISGLQSEDEADYYCASWDDSLNGRVFGGGTKLTVL

SEQ ID NO: 810 - protein, 110 aa, Artificial Sequence
  VL
QSVLTQPPSASGTPGQRVTISCSGSSSNIGSNTVNWYQRLPGAAPQLLIYNNDQRPSGIPDRFSGSKSGTCGSLVISGLQSEDEADYYCASWDDSLNGRVFGGGTKLTVL

SEQ ID NO: 811 - protein, 110 aa, Artificial Sequence
  VL
QSVLTQPPSASGTPGQRVTISCSGSSSNIGSNTVNWYQRLPGAAPQLLIYNNDQRPSGIPDRFSGSKSGTSGCLVISGLQSEDEADYYCASWDDSLNGRVFGGGTKLTVL

SEQ ID NO: 812 - protein, 110 aa, Artificial Sequence
  VL
QSVLTQPPSASGTPGQRVTISCSGSSSNIGSNTVNWYQRLPGAAPQLLIYNNDQRPSGIPDRFSGSKSGTSGSCVISGLQSEDEADYYCASWDDSLNGRVFGGGTKLTVL

SEQ ID NO: 813 - protein, 110 aa, Artificial Sequence
  VL
QSVLTQPPSASGTPGQRVTISCSGSSSNIGSNTVNWYQRLPGAAPQLLIYNNDQRPSGIPDRFSGSKSGTSGSLCISGLQSEDEADYYCASWDDSLNGRVFGGGTKLTVL

SEQ ID NO: 814 - protein, 110 aa, Artificial Sequence
  VL
QSVLTQPPSASGTPGQRVTISCSGSSSNIGSNTVNWYQRLPGAAPQLLIYNNDQRPSGIPDRFSGSKSGTSGSLVCSGLQSEDEADYYCASWDDSLNGRVFGGGTKLTVL

SEQ ID NO: 815 - protein, 110 aa, Artificial Sequence
  VL
QSVLTQPPSASGTPGQRVTISCSGSSSNIGSNTVNWYQRLPGAAPQLLIYNNDQRPSGIPDRFSGSKSGTSGSLVICGLQSEDEADYYCASWDDSLNGRVFGGGTKLTVL

SEQ ID NO: 816 - protein, 110 aa, Artificial Sequence
  VL
QSVLTQPPSASGTPGQRVTISCSGSSSNIGSNTVNWYQRLPGAAPQLLIYNNDQRPSGIPDRFSGSKSGTSGSLVISCLQSEDEADYYCASWDDSLNGRVFGGGTKLTVL

SEQ ID NO: 817 - protein, 110 aa, Artificial Sequence
  VL
QSVLTQPPSASGTPGQRVTISCSGSSSNIGSNTVNWYQRLPGAAPQLLIYNNDQRPSGIPDRFSGSKSGTSGSLVISGCQSEDEADYYCASWDDSLNGRVFGGGTKLTVL

SEQ ID NO: 818 - protein, 110 aa, Artificial Sequence
  VL
QSVLTQPPSASGTPGQRVTISCSGSSSNIGSNTVNWYQRLPGAAPQLLIYNNDQRPSGIPDRFSGSKSGTSGSLVISGLCSEDEADYYCASWDDSLNGRVFGGGTKLTVL

SEQ ID NO: 819 - protein, 110 aa, Artificial Sequence
  VL
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGCVFGGGTKLTVL

SEQ ID NO: 820 - protein, 110 aa, Artificial Sequence
  VL
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRCFGGGTKLTVL

SEQ ID NO: 821 - protein, 110 aa, Artificial Sequence
  VL
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVCGGGTKLTVL

SEQ ID NO: 822 - protein, 110 aa, Artificial Sequence
  VL
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFCGGTKLTVL

SEQ ID NO: 823 - protein, 110 aa, Artificial Sequence
  VL
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGCGTKLTVL

SEQ ID NO: 824 - protein, 110 aa, Artificial Sequence
  VL
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGCTKLTVL

SEQ ID NO: 825 - protein, 110 aa, Artificial Sequence
  VL
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGCKLTVL

SEQ ID NO: 826 - protein, 110 aa, Artificial Sequence
  VL
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTCLTVL

SEQ ID NO: 827 - protein, 110 aa, Artificial Sequence
  VL
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKCTVL

SEQ ID NO: 828 - protein, 110 aa, Artificial Sequence
  VL
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLCVL

SEQ ID NO: 829 - protein, 110 aa, Artificial Sequence
  VL
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTCL

SEQ ID NO: 830 - protein, 110 aa, Artificial Sequence
  VL
QSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVC

SEQ ID NO: 831 - protein, 106 aa, Artificial Sequence
  CL
GCPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 832 - protein, 106 aa, Artificial Sequence
  CL
GQCKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 833 - protein, 106 aa, Artificial Sequence
  CL
GQPCAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 834 - protein, 106 aa, Artificial Sequence
  CL
GQPKCAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 835 - protein, 106 aa, Artificial Sequence
  CL
GQPKACPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 836 - protein, 106 aa, Artificial Sequence
  CL
GQPKAACSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 837 - protein, 106 aa, Artificial Sequence
  CL
GQPKAAPCVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 838 - protein, 106 aa, Artificial Sequence
  CL
GQPKAAPSCTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 839 - protein, 106 aa, Artificial Sequence
  CL
GQPKAAPSVCLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 840 - protein, 106 aa, Artificial Sequence
  CL
GQPKAAPSVTLFPCSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 841 - protein, 106 aa, Artificial Sequence
  CL
GQPKAAPSVTLFPPCSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 842 - protein, 106 aa, Artificial Sequence
  CL
GQPKAAPSVTLFPPSCEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 843 - protein, 106 aa, Artificial Sequence
  CL
GQPKAAPSVTLFPPSSCELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 844 - protein, 106 aa, Artificial Sequence
  CL
GQPKAAPSVTLFPPSSECLQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 845 - protein, 106 aa, Artificial Sequence
  CL
GQPKAAPSVTLFPPSSEECQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 846 - protein, 106 aa, Artificial Sequence
  CL
GQPKAAPSVTLFPPSSEELCANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 847 - protein, 106 aa, Artificial Sequence
  CL
GQPKAAPSVTLFPPSSEELQCNKATLVCLISDFYPGAVTVAWKADSSPVKAGVETTTPSKQSNNKYAASSYLSLTPEQWKSHRSYSCQVTHEGSTVEKTVAPTECS

SEQ ID NO: 848 - protein, 106 aa, Artificial Sequence
  CL
GQPKAAPSVTLFPPSSEELQACKATLVCLISDFYPGAVTVAWKADSSPVKAGVETTTPSKQSNNKYAASSYLSLTPEQWKSHRSYSCQVTHEGSTVEKTVAPTECS

SEQ ID NO: 849 - protein, 106 aa, Artificial Sequence
  CL
GQPKAAPSVTLFPPSSEELQANCATLVCLISDFYPGAVTVAWKADSSPVKAGVETTTPSKQSNNKYAASSYLSLTPEQWKSHRSYSCQVTHEGSTVEKTVAPTECS

SEQ ID NO: 850 - protein, 106 aa, Artificial Sequence
  CL
GQPKAAPSVTLFPPSSEELQANKCTLVCLISDFYPGAVTVAWKADSSPVKAGVETTTPSKQSNNKYAASSYLSLTPEQWKSHRSYSCQVTHEGSTVEKTVAPTECS

SEQ ID NO: 851 - protein, 106 aa, Artificial Sequence
  CL
GQPKAAPSVTLFPPSSEELQANKACLVCLISDFYPGAVTVAWKADSSPVKAGVETTTPSKQSNNKYAASSYLSLTPEQWKSHRSYSCQVTHEGSTVEKTVAPTECS

SEQ ID NO: 852 - protein, 106 aa, Artificial Sequence
  CL
GQPKAAPSVTLFPPSSEELQANKATLVCLCSDFYPGAVTVAWKADSSPVKAGVETTTPSKQSNNKYAASSYLSLTPEQWKSHRSYSCQVTHEGSTVEKTVAPTECS

SEQ ID NO: 853 - protein, 106 aa, Artificial Sequence
  CL
GQPKAAPSVTLFPPSSEELQANKATLVCLICDFYPGAVTVAWKADSSPVKAGVETTTPSKQSNNKYAASSYLSLTPEQWKSHRSYSCQVTHEGSTVEKTVAPTECS

SEQ ID NO: 854 - protein, 106 aa, Artificial Sequence
  CL
GQPKAAPSVTLFPPSSEELQANKATLVCLISCFYPGAVTVAWKADSSPVKAGVETTTPSKQSNNKYAASSYLSLTPEQWKSHRSYSCQVTHEGSTVEKTVAPTECS

SEQ ID NO: 855 - protein, 106 aa, Artificial Sequence
  CL
GQPKAAPSVTLFPPSSEELQANKATLVCLISDCYPGAVTVAWKADSSPVKAGVETTTPSKQSNNKYAASSYLSLTPEQWKSHRSYSCQVTHEGSTVEKTVAPTECS

SEQ ID NO: 856 - protein, 106 aa, Artificial Sequence
  CL
GQPKAAPSVTLFPPSSEELQANKATLVCLISDFCPGAVTVAWKADSSPVKAGVETTTPSKQSNNKYAASSYLSLTPEQWKSHRSYSCQVTHEGSTVEKTVAPTECS

SEQ ID NO: 857 - protein, 106 aa, Artificial Sequence
  CL
GQPKAAPSVTLFPPSSEELQANKATLVCLISDFYCGAVTVAWKADSSPVKAGVETTTPSKQSNNKYAASSYLSLTPEQWKSHRSYSCQVTHEGSTVEKTVAPTECS

SEQ ID NO: 858 - protein, 106 aa, Artificial Sequence
  CL
GQPKAAPSVTLFPPSSEELQANKATLVCLISDFYPCAVTVAWKADSSPVKAGVETTTPSKQSNNKYAASSYLSLTPEQWKSHRSYSCQVTHEGSTVEKTVAPTECS

SEQ ID NO: 859 - protein, 106 aa, Artificial Sequence
  CL
GQPKAAPSVTLFPPSSEELQANKATLVCLISDFYPGCVTVAWKADSSPVKAGVETTTPSKQSNNKYAASSYLSLTPEQWKSHRSYSCQVTHEGSTVEKTVAPTECS

SEQ ID NO: 860 - protein, 106 aa, Artificial Sequence
  CL
GQPKAAPSVTLFPPSSEELQANKATLVCLISDFYPGACTVAWKADSSPVKAGVETTTPSKQSNNKYAASSYLSLTPEQWKSHRSYSCQVTHEGSTVEKTVAPTECS

SEQ ID NO: 861 - protein, 106 aa, Artificial Sequence
  CL
GQPKAAPSVTLFPPSSEELQANKATLVCLISDFYPGAVCVAWKADSSPVKAGVETTTPSKQSNNKYAASSYLSLTPEQWKSHRSYSCQVTHEGSTVEKTVAPTECS

SEQ ID NO: 862 - protein, 106 aa, Artificial Sequence
  CL
GQPKAAPSVTLFPPSSEELQANKATLVCLISDFYPGAVTCAWKADSSPVKAGVETTTPSKQSNNKYAASSYLSLTPEQWKSHRSYSCQVTHEGSTVEKTVAPTECS

SEQ ID NO: 863 - protein, 106 aa, Artificial Sequence
  CL
GQPKAAPSVTLFPPSSEELQANKATLVCLISDFYPGAVTVCWKADSSPVKAGVETTTPSKQSNNKYAASSYLSLTPEQWKSHRSYSCQVTHEGSTVEKTVAPTECS

SEQ ID NO: 864 - protein, 106 aa, Artificial Sequence
  CL
GQPKAAPSVTLFPPSSEELQANKATLVCLISDFYPGAVTVACKADSSPVKAGVETTTPSKQSNNKYAASSYLSLTPEQWKSHRSYSCQVTHEGSTVEKTVAPTECS

SEQ ID NO: 865 - protein, 106 aa, Artificial Sequence
  CL
GQPKAAPSVTLFPPSSEELQANKATLVCLISDFYPGAVTVAWCADSSPVKAGVETTTPSKQSNNKYAASSYLSLTPEQWKSHRSYSCQVTHEGSTVEKTVAPTECS

SEQ ID NO: 866 - protein, 106 aa, Artificial Sequence
  CL
GQPKAAPSVTLFPPSSEELQANKATLVCLISDFYPGAVTVAWKCDSSPVKAGVETTTPSKQSNNKYAASSYLSLTPEQWKSHRSYSCQVTHEGSTVEKTVAPTECS

SEQ ID NO: 867 - protein, 106 aa, Artificial Sequence
  CL
GQPKAAPSVTLFPPSSEELQANKATLVCLISDFYPGAVTVAWKACSSPVKAGVETTTPSKQSNNKYAASSYLSLTPEQWKSHRSYSCQVTHEGSTVEKTVAPTECS

SEQ ID NO: 868 - protein, 106 aa, Artificial Sequence
  CL
GQPKAAPSVTLFPPSSEELQANKATLVCLISDFYPGAVTVAWKADCSPVKAGVETTTPSKQSNNKYAASSYLSLTPEQWKSHRSYSCQVTHEGSTVEKTVAPTECS

SEQ ID NO: 869 - protein, 106 aa, Artificial Sequence
  CL
GQPKAAPSVTLFPPSSEELQANKATLVCLISDFYPGAVTVAWKADSCPVKAGVETTTPSKQSNNKYAASSYLSLTPEQWKSHRSYSCQVTHEGSTVEKTVAPTECS

SEQ ID NO: 870 - protein, 106 aa, Artificial Sequence
  CL
GQPKAAPSVTLFPPSSEELQANKATLVCLISDFYPGAVTVAWKADSSCVKAGVETTTPSKQSNNKYAASSYLSLTPEQWKSHRSYSCQVTHEGSTVEKTVAPTECS

SEQ ID NO: 871 - protein, 106 aa, Artificial Sequence
  CL
GQPKAAPSVTLFPPSSEELQANKATLVCLISDFYPGAVTVAWKADSSPCKAGVETTTPSKQSNNKYAASSYLSLTPEQWKSHRSYSCQVTHEGSTVEKTVAPTECS

SEQ ID NO: 872 - protein, 106 aa, Artificial Sequence
  CL
GQPKAAPSVTLFPPSSEELQANKATLVCLISDFYPGAVTVAWKADSSPVCAGVETTTPSKQSNNKYAASSYLSLTPEQWKSHRSYSCQVTHEGSTVEKTVAPTECS

SEQ ID NO: 873 - protein, 106 aa, Artificial Sequence
  CL
GQPKAAPSVTLFPPSSEELQANKATLVCLISDFYPGAVTVAWKADSSPVKCGVETTTPSKQSNNKYAASSYLSLTPEQWKSHRSYSCQVTHEGSTVEKTVAPTECS

SEQ ID NO: 874 - protein, 106 aa, Artificial Sequence
  CL
GQPKAAPSVTLFPPSSEELQANKATLVCLISDFYPGAVTVAWKADSSPVKACVETTTPSKQSNNKYAASSYLSLTPEQWKSHRSYSCQVTHEGSTVEKTVAPTECS

SEQ ID NO: 875 - protein, 106 aa, Artificial Sequence
  CL
GQPKAAPSVTLFPPSSEELQANKATLVCLISDFYPGAVTVAWKADSSPVKAGCETTTPSKQSNNKYAASSYLSLTPEQWKSHRSYSCQVTHEGSTVEKTVAPTECS

SEQ ID NO: 876 - protein, 106 aa, Artificial Sequence
  CL
GQPKAAPSVTLFPPSSEELQANKATLVCLISDFYPGAVTVAWKADSSPVKAGVCTTTPSKQSNNKYAASSYLSLTPEQWKSHRSYSCQVTHEGSTVEKTVAPTECS

SEQ ID NO: 877 - protein, 106 aa, Artificial Sequence
  CL
GQPKAAPSVTLFPPSSEELQANKATLVCLISDFYPGAVTVAWKADSSPVKAGVECTTPSKQSNNKYAASSYLSLTPEQWKSHRSYSCQVTHEGSTVEKTVAPTECS

SEQ ID NO: 878 - protein, 106 aa, Artificial Sequence
  CL
GQPKAAPSVTLFPPSSEELQANKATLVCLISDFYPGAVTVAWKADSSPVKAGVETCTPSKQSNNKYAASSYLSLTPEQWKSHRSYSCQVTHEGSTVEKTVAPTECS

SEQ ID NO: 879 - protein, 106 aa, Artificial Sequence
  CL
GQPKAAPSVTLFPPSSEELQANKATLVCLISDFYPGAVTVAWKADSSPVKAGVETTCPSKQSNNKYAASSYLSLTPEQWKSHRSYSCQVTHEGSTVEKTVAPTECS

SEQ ID NO: 880 - protein, 106 aa, Artificial Sequence
  CL
GQPKAAPSVTLFPPSSEELQANKATLVCLISDFYPGAVTVAWKADSSPVKAGVETTTCSKQSNNKYAASSYLSLTPEQWKSHRSYSCQVTHEGSTVEKTVAPTECS

SEQ ID NO: 881 - protein, 106 aa, Artificial Sequence
  CL
GQPKAAPSVTLFPPSSEELQANKATLVCLISDFYPGAVTVAWKADSSPVKAGVETTTPCKQSNNKYAASSYLSLTPEQWKSHRSYSCQVTHEGSTVEKTVAPTECS

SEQ ID NO: 882 - protein, 106 aa, Artificial Sequence
  CL
GQPKAAPSVTLFPPSSEELQANKATLVCLISDFYPGAVTVAWKADSSPVKAGVETTTPSCQSNNKYAASSYLSLTPEQWKSHRSYSCQVTHEGSTVEKTVAPTECS

SEQ ID NO: 883 - protein, 106 aa, Artificial Sequence
  CL
GQPKAAPSVTLFPPSSEELQANKATLVCLISDFYPGAVTVAWKADSSPVKAGVETTTPSKCSNNKYAASSYLSLTPEQWKSHRSYSCQVTHEGSTVEKTVAPTECS

SEQ ID NO: 884 - protein, 106 aa, Artificial Sequence
  CL
GQPKAAPSVTLFPPSSEELQANKATLVCLISDFYPGAVTVAWKADSSPVKAGVETTTPSKQCNNKYAASSYLSLTPEQWKSHRSYSCQVTHEGSTVEKTVAPTECS

SEQ ID NO: 885 - protein, 106 aa, Artificial Sequence
  CL
GQPKAAPSVTLFPPSSEELQANKATLVCLISDFYPGAVTVAWKADSSPVKAGVETTTPSKQSCNKYAASSYLSLTPEQWKSHRSYSCQVTHEGSTVEKTVAPTECS

SEQ ID NO: 886 - protein, 106 aa, Artificial Sequence
  CL
GQPKAAPSVTLFPPSSEELQANKATLVCLISDFYPGAVTVAWKADSSPVKAGVETTTPSKQSNCKYAASSYLSLTPEQWKSHRSYSCQVTHEGSTVEKTVAPTECS

SEQ ID NO: 887 - protein, 106 aa, Artificial Sequence
  CL
GQPKAAPSVTLFPPSSEELQANKATLVCLISDFYPGAVTVAWKADSSPVKAGVETTTPSKQSNNCYAASSYLSLTPEQWKSHRSYSCQVTHEGSTVEKTVAPTECS

SEQ ID NO: 888 - protein, 106 aa, Artificial Sequence
  CL
GQPKAAPSVTLFPPSSEELQANKATLVCLISDFYPGAVTVAWKADSSPVKAGVETTTPSKQSNNKCAASSYLSLTPEQWKSHRSYSCQVTHEGSTVEKTVAPTECS

SEQ ID NO: 889 - protein, 106 aa, Artificial Sequence
  CL
GQPKAAPSVTLFPPSSEELQANKATLVCLISDFYPGAVTVAWKADSSPVKAGVETTTPSKQSNNKYCASSYLSLTPEQWKSHRSYSCQVTHEGSTVEKTVAPTECS

SEQ ID NO: 890 - protein, 106 aa, Artificial Sequence
  CL
GQPKAAPSVTLFPPSSEELQANKATLVCLISDFYPGAVTVAWKADSSPVKAGVETTTPSKQSNNKYACSSYLSLTPEQWKSHRSYSCQVTHEGSTVEKTVAPTECS

SEQ ID NO: 891 - protein, 106 aa, Artificial Sequence
  CL
GQPKAAPSVTLFPPSSEELQANKATLVCLISDFYPGAVTVAWKADSSPVKAGVETTTPSKQSNNKYAASSYLCLTPEQWKSHRSYSCQVTHEGSTVEKTVAPTECS

SEQ ID NO: 892 - protein, 106 aa, Artificial Sequence
  CL
GQPKAAPSVTLFPPSSEELQANKATLVCLISDFYPGAVTVAWKADSSPVKAGVETTTPSKQSNNKYAASSYLSCTPEQWKSHRSYSCQVTHEGSTVEKTVAPTECS

SEQ ID NO: 893 - protein, 106 aa, Artificial Sequence
  CL
GQPKAAPSVTLFPPSSEELQANKATLVCLISDFYPGAVTVAWKADSSPVKAGVETTTPSKQSNNKYAASSYLSLCPEQWKSHRSYSCQVTHEGSTVEKTVAPTECS

SEQ ID NO: 894 - protein, 106 aa, Artificial Sequence
  CL
GQPKAAPSVTLFPPSSEELQANKATLVCLISDFYPGAVTVAWKADSSPVKAGVETTTPSKQSNNKYAASSYLSLTCEQWKSHRSYSCQVTHEGSTVEKTVAPTECS

SEQ ID NO: 895 - protein, 106 aa, Artificial Sequence
  CL
GQPKAAPSVTLFPPSSEELQANKATLVCLISDFYPGAVTVAWKADSSPVKAGVETTTPSKQSNNKYAASSYLSLTPCQWKSHRSYSCQVTHEGSTVEKTVAPTECS

SEQ ID NO: 896 - protein, 106 aa, Artificial Sequence
  CL
GQPKAAPSVTLFPPSSEELQANKATLVCLISDFYPGAVTVAWKADSSPVKAGVETTTPSKQSNNKYAASSYLSLTPECWKSHRSYSCQVTHEGSTVEKTVAPTECS

SEQ ID NO: 897 - protein, 106 aa, Artificial Sequence
  CL
GQPKAAPSVTLFPPSSEELQANKATLVCLISDFYPGAVTVAWKADSSPVKAGVETTTPSKQSNNKYAASSYLSLTPEQCKSHRSYSCQVTHEGSTVEKTVAPTECS

SEQ ID NO: 898 - protein, 106 aa, Artificial Sequence
  CL
GQPKAAPSVTLFPPSSEELQANKATLVCLISDFYPGAVTVAWKADSSPVKAGVETTTPSKQSNNKYAASSYLSLTPEQWCSHRSYSCQVTHEGSTVEKTVAPTECS

SEQ ID NO: 899 - protein, 106 aa, Artificial Sequence
  CL
GQPKAAPSVTLFPPSSEELQANKATLVCLISDFYPGAVTVAWKADSSPVKAGVETTTPSKQSNNKYAASSYLSLTPEQWKCHRSYSCQVTHEGSTVEKTVAPTECS

SEQ ID NO: 900 - protein, 106 aa, Artificial Sequence
  CL
GQPKAAPSVTLFPPSSEELQANKATLVCLISDFYPGAVTVAWKADSSPVKAGVETTTPSKQSNNKYAASSYLSLTPEQWKSCRSYSCQVTHEGSTVEKTVAPTECS

SEQ ID NO: 901 - protein, 106 aa, Artificial Sequence
  CL
GQPKAAPSVTLFPPSSEELQANKATLVCLISDFYPGAVTVAWKADSSPVKAGVETTTPSKQSNNKYAASSYLSLTPEQWKSHCSYSCQVTHEGSTVEKTVAPTECS

SEQ ID NO: 902 - protein, 106 aa, Artificial Sequence
  CL
GQPKAAPSVTLFPPSSEELQANKATLVCLISDFYPGAVTVAWKADSSPVKAGVETTTPSKQSNNKYAASSYLSLTPEQWKSHRCYSCQVTHEGSTVEKTVAPTECS

SEQ ID NO: 903 - protein, 106 aa, Artificial Sequence
  CL
GQPKAAPSVTLFPPSSEELQANKATLVCLISDFYPGAVTVAWKADSSPVKAGVETTTPSKQSNNKYAASSYLSLTPEQWKSHRSCSCQVTHEGSTVEKTVAPTECS

SEQ ID NO: 904 - protein, 106 aa, Artificial Sequence
  CL
GQPKAAPSVTLFPPSSEELQANKATLVCLISDFYPGAVTVAWKADSSPVKAGVETTTPSKQSNNKYAASSYLSLTPEQWKSHRSYCCQVTHEGSTVEKTVAPTECS

SEQ ID NO: 905 - protein, 106 aa, Artificial Sequence
  CL
GQPKAAPSVTLFPPSSEELQANKATLVCLISDFYPGAVTVAWKADSSPVKAGVETTTPSKQSNNKYAASSYLSLTPEQWKSHRSYSCCVTHEGSTVEKTVAPTECS

SEQ ID NO: 906 - protein, 106 aa, Artificial Sequence
  CL
GQPKAAPSVTLFPPSSEELQANKATLVCLISDFYPGAVTVAWKADSSPVKAGVETTTPSKQSNNKYAASSYLSLTPEQWKSHRSYSCQCTHEGSTVEKTVAPTECS

SEQ ID NO: 907 - protein, 106 aa, Artificial Sequence
  CL
GQPKAAPSVTLFPPSSEELQANKATLVCLISDFYPGAVTVAWKADSSPVKAGVETTTPSKQSNNKYAASSYLSLTPEQWKSHRSYSCQVCHEGSTVEKTVAPTECS

SEQ ID NO: 908 - protein, 106 aa, Artificial Sequence
  CL
GQPKAAPSVTLFPPSSEELQANKATLVCLISDFYPGAVTVAWKADSSPVKAGVETTTPSKQSNNKYAASSYLSLTPEQWKSHRSYSCQVTCEGSTVEKTVAPTECS

SEQ ID NO: 909 - protein, 106 aa, Artificial Sequence
  CL
GQPKAAPSVTLFPPSSEELQANKATLVCLISDFYPGAVTVAWKADSSPVKAGVETTTPSKQSNNKYAASSYLSLTPEQWKSHRSYSCQVTHCGSTVEKTVAPTECS

SEQ ID NO: 910 - protein, 106 aa, Artificial Sequence
  CL
GQPKAAPSVTLFPPSSEELQANKATLVCLISDFYPGAVTVAWKADSSPVKAGVETTTPSKQSNNKYAASSYLSLTPEQWKSHRSYSCQVTHECSTVEKTVAPTECS

SEQ ID NO: 911 - protein, 106 aa, Artificial Sequence
  CL
GQPKAAPSVTLFPPSSEELQANKATLVCLISDFYPGAVTVAWKADSSPVKAGVETTTPSKQSNNKYAASSYLSLTPEQWKSHRSYSCQVTHEGCTVEKTVAPTECS

SEQ ID NO: 912 - protein, 106 aa, Artificial Sequence
  CL
GQPKAAPSVTLFPPSSEELQANKATLVCLISDFYPGAVTVAWKADSSPVKAGVETTTPSKQSNNKYAASSYLSLTPEQWKSHRSYSCQVTHEGSCVEKTVAPTECS

SEQ ID NO: 913 - protein, 106 aa, Artificial Sequence
  CL
GQPKAAPSVTLFPPSSEELQANKATLVCLISDFYPGAVTVAWKADSSPVKAGVETTTPSKQSNNKYAASSYLSLTPEQWKSHRSYSCQVTHEGSTCEKTVAPTECS

SEQ ID NO: 914 - protein, 106 aa, Artificial Sequence
  CL
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVCKTVAPTECS

SEQ ID NO: 915 - protein, 106 aa, Artificial Sequence
  CL
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVECTVAPTECS

SEQ ID NO: 916 - protein, 106 aa, Artificial Sequence
  CL
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKCVAPTECS

SEQ ID NO: 917 - protein, 106 aa, Artificial Sequence
  CL
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTCAPTECS

SEQ ID NO: 918 - protein, 106 aa, Artificial Sequence
  CL
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVCPTECS

SEQ ID NO: 919 - protein, 106 aa, Artificial Sequence
  CL
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVACTECS

SEQ ID NO: 920 - protein, 106 aa, Artificial Sequence
  CL
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPCECS

SEQ ID NO: 921 - protein, 106 aa, Artificial Sequence
  CL
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTCCS

SEQ ID NO: 922 - protein, 127 aa, Artificial Sequence
  VHH
CVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 923 - protein, 127 aa, Artificial Sequence
  VHH
ECQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 924 - protein, 127 aa, Artificial Sequence
  VHH
EVCLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 925 - protein, 127 aa, Artificial Sequence
  VHH
EVQCVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 926 - protein, 127 aa, Artificial Sequence
  VHH
EVQLCESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 927 - protein, 127 aa, Artificial Sequence
  VHH
EVQLVCSGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 928 - protein, 127 aa, Artificial Sequence
  VHH
EVQLVECGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 929 - protein, 127 aa, Artificial Sequence
  VHH
EVQLVESCGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 930 - protein, 127 aa, Artificial Sequence
  VHH
EVQLVESGCGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 931 - protein, 127 aa, Artificial Sequence
  VHH
EVQLVESGGCLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 932 - protein, 127 aa, Artificial Sequence
  VHH
EVQLVESGGGCVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 933 - protein, 127 aa, Artificial Sequence
  VHH
EVQLVESGGGLCQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 934 - protein, 127 aa, Artificial Sequence
  VHH
EVQLVESGGGLVCPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 935 - protein, 127 aa, Artificial Sequence
  VHH
EVQLVESGGGLVQCGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 936 - protein, 127 aa, Artificial Sequence
  VHH
EVQLVESGGGLVQPCGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 937 - protein, 127 aa, Artificial Sequence
  VHH
EVQLVESGGGLVQPGCSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 938 - protein, 127 aa, Artificial Sequence
  VHH
EVQLVESGGGLVQPGGCLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 939 - protein, 127 aa, Artificial Sequence
  VHH
EVQLVESGGGLVQPGGSCRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 940 - protein, 127 aa, Artificial Sequence
  VHH
EVQLVESGGGLVQPGGSLCLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 941 - protein, 127 aa, Artificial Sequence
  VHH
EVQLVESGGGLVQPGGSLRCSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 942 - protein, 127 aa, Artificial Sequence
  VHH
EVQLVESGGGLVQPGGSLRLCCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 943 - protein, 127 aa, Artificial Sequence
  VHH
EVQLVESGGGLVQPGGSLRLSCCASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 944 - protein, 127 aa, Artificial Sequence
  VHH
EVQLVESGGGLVQPGGSLRLSCACSGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 945 - protein, 127 aa, Artificial Sequence
  VHH
EVQLVESGGGLVQPGGSLRLSCAACGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 946 - protein, 127 aa, Artificial Sequence
  VHH
EVQLVESGGGLVQPGGSLRLSCAASCFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 947 - protein, 127 aa, Artificial Sequence
  VHH
EVQLVESGGGLVQPGGSLRLSCAASGCTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 948 - protein, 127 aa, Artificial Sequence
  VHH
EVQLVESGGGLVQPGGSLRLSCAASGFCFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 949 - protein, 127 aa, Artificial Sequence
  VHH
EVQLVESGGGLVQPGGSLRLSCAASGFTCDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 950 - protein, 127 aa, Artificial Sequence
  VHH
EVQLVESGGGLVQPGGSLRLSCAASGFTFCDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 951 - protein, 127 aa, Artificial Sequence
  VHH
EVQLVESGGGLVQPGGSLRLSCAASGFTFDDYGMSCVRQAPGKALEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 952 - protein, 127 aa, Artificial Sequence
  VHH
EVQLVESGGGLVQPGGSLRLSCAASGFTFDDYGMSWCRQAPGKALEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 953 - protein, 127 aa, Artificial Sequence
  VHH
EVQLVESGGGLVQPGGSLRLSCAASGFTFDDYGMSWVCQAPGKALEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 954 - protein, 127 aa, Artificial Sequence
  VHH
EVQLVESGGGLVQPGGSLRLSCAASGFTFDDYGMSWVRCAPGKALEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 955 - protein, 127 aa, Artificial Sequence
  VHH
EVQLVESGGGLVQPGGSLRLSCAASGFTFDDYGMSWVRQCPGKALEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 956 - protein, 127 aa, Artificial Sequence
  VHH
EVQLVESGGGLVQPGGSLRLSCAASGFTFDDYGMSWVRQACGKALEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 957 - protein, 127 aa, Artificial Sequence
  VHH
EVQLVESGGGLVQPGGSLRLSCAASGFTFDDYGMSWVRQAPCKALEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 958 - protein, 127 aa, Artificial Sequence
  VHH
EVQLVESGGGLVQPGGSLRLSCAASGFTFDDYGMSWVRQAPGCALEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 959 - protein, 127 aa, Artificial Sequence
  VHH
EVQLVESGGGLVQPGGSLRLSCAASGFTFDDYGMSWVRQAPGKCLEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 960 - protein, 127 aa, Artificial Sequence
  VHH
EVQLVESGGGLVQPGGSLRLSCAASGFTFDDYGMSWVRQAPGKACEWVSAISWNGNNTYYTESMKGRFTISRDNAKNTLYLQMNSLRPEDTAVYYCVKGSTAIVGVPPTYPDEYDYWGQGTLVTVSS

SEQ ID NO: 961 - protein, 127 aa, Artificial Sequence
  VHH
EVQLVESGGGLVQPGGSLRLSCAASGFTFDDYGMSWVRQAPGKALCWVSAISWNGNNTYYTESMKGRFTISRDNAKNTLYLQMNSLRPEDTAVYYCVKGSTAIVGVPPTYPDEYDYWGQGTLVTVSS

SEQ ID NO: 962 - protein, 127 aa, Artificial Sequence
  VHH
EVQLVESGGGLVQPGGSLRLSCAASGFTFDDYGMSWVRQAPGKALECVSAISWNGNNTYYTESMKGRFTISRDNAKNTLYLQMNSLRPEDTAVYYCVKGSTAIVGVPPTYPDEYDYWGQGTLVTVSS

SEQ ID NO: 963 - protein, 127 aa, Artificial Sequence
  VHH
EVQLVESGGGLVQPGGSLRLSCAASGFTFDDYGMSWVRQAPGKALEWCSAISWNGNNTYYTESMKGRFTISRDNAKNTLYLQMNSLRPEDTAVYYCVKGSTAIVGVPPTYPDEYDYWGQGTLVTVSS

SEQ ID NO: 964 - protein, 127 aa, Artificial Sequence
  VHH
EVQLVESGGGLVQPGGSLRLSCAASGFTFDDYGMSWVRQAPGKALEWVCAISWNGNNTYYTESMKGRFTISRDNAKNTLYLQMNSLRPEDTAVYYCVKGSTAIVGVPPTYPDEYDYWGQGTLVTVSS

SEQ ID NO: 965 - protein, 127 aa, Artificial Sequence
  VHH
EVQLVESGGGLVQPGGSLRLSCAASGFTFDDYGMSWVRQAPGKALEWVSAISWNGNNTYYTESMKGCFTISRDNAKNTLYLQMNSLRPEDTAVYYCVKGSTAIVGVPPTYPDEYDYWGQGTLVTVSS

SEQ ID NO: 966 - protein, 127 aa, Artificial Sequence
  VHH
EVQLVESGGGLVQPGGSLRLSCAASGFTFDDYGMSWVRQAPGKALEWVSAISWNGNNTYYTESMKGRCTISRDNAKNTLYLQMNSLRPEDTAVYYCVKGSTAIVGVPPTYPDEYDYWGQGTLVTVSS

SEQ ID NO: 967 - protein, 127 aa, Artificial Sequence
  VHH
EVQLVESGGGLVQPGGSLRLSCAASGFTFDDYGMSWVRQAPGKALEWVSAISWNGNNTYYTESMKGRFCISRDNAKNTLYLQMNSLRPEDTAVYYCVKGSTAIVGVPPTYPDEYDYWGQGTLVTVSS

SEQ ID NO: 968 - protein, 127 aa, Artificial Sequence
  VHH
EVQLVESGGGLVQPGGSLRLSCAASGFTFDDYGMSWVRQAPGKALEWVSAISWNGNNTYYTESMKGRFTCSRDNAKNTLYLQMNSLRPEDTAVYYCVKGSTAIVGVPPTYPDEYDYWGQGTLVTVSS

SEQ ID NO: 969 - protein, 127 aa, Artificial Sequence
  VHH
EVQLVESGGGLVQPGGSLRLSCAASGFTFDDYGMSWVRQAPGKALEWVSAISWNGNNTYYTESMKGRFTICRDNAKNTLYLQMNSLRPEDTAVYYCVKGSTAIVGVPPTYPDEYDYWGQGTLVTVSS

SEQ ID NO: 970 - protein, 127 aa, Artificial Sequence
  VHH
EVQLVESGGGLVQPGGSLRLSCAASGFTFDDYGMSWVRQAPGKALEWVSAISWNGNNTYYTESMKGRFTISCDNAKNTLYLQMNSLRPEDTAVYYCVKGSTAIVGVPPTYPDEYDYWGQGTLVTVSS

SEQ ID NO: 971 - protein, 127 aa, Artificial Sequence
  VHH
EVQLVESGGGLVQPGGSLRLSCAASGFTFDDYGMSWVRQAPGKALEWVSAISWNGNNTYYTESMKGRFTISRCNAKNTLYLQMNSLRPEDTAVYYCVKGSTAIVGVPPTYPDEYDYWGQGTLVTVSS

SEQ ID NO: 972 - protein, 127 aa, Artificial Sequence
  VHH
EVQLVESGGGLVQPGGSLRLSCAASGFTFDDYGMSWVRQAPGKALEWVSAISWNGNNTYYTESMKGRFTISRDCAKNTLYLQMNSLRPEDTAVYYCVKGSTAIVGVPPTYPDEYDYWGQGTLVTVSS

SEQ ID NO: 973 - protein, 127 aa, Artificial Sequence
  VHH
EVQLVESGGGLVQPGGSLRLSCAASGFTFDDYGMSWVRQAPGKALEWVSAISWNGNNTYYTESMKGRFTISRDNCKNTLYLQMNSLRPEDTAVYYCVKGSTAIVGVPPTYPDEYDYWGQGTLVTVSS

SEQ ID NO: 974 - protein, 127 aa, Artificial Sequence
  VHH
EVQLVESGGGLVQPGGSLRLSCAASGFTFDDYGMSWVRQAPGKALEWVSAISWNGNNTYYTESMKGRFTISRDNACNTLYLQMNSLRPEDTAVYYCVKGSTAIVGVPPTYPDEYDYWGQGTLVTVSS

SEQ ID NO: 975 - protein, 127 aa, Artificial Sequence
  VHH
EVQLVESGGGLVQPGGSLRLSCAASGFTFDDYGMSWVRQAPGKALEWVSAISWNGNNTYYTESMKGRFTISRDNAKCTLYLQMNSLRPEDTAVYYCVKGSTAIVGVPPTYPDEYDYWGQGTLVTVSS

SEQ ID NO: 976 - protein, 127 aa, Artificial Sequence
  VHH
EVQLVESGGGLVQPGGSLRLSCAASGFTFDDYGMSWVRQAPGKALEWVSAISWNGNNTYYTESMKGRFTISRDNAKNCLYLQMNSLRPEDTAVYYCVKGSTAIVGVPPTYPDEYDYWGQGTLVTVSS

SEQ ID NO: 977 - protein, 127 aa, Artificial Sequence
  VHH
EVQLVESGGGLVQPGGSLRLSCAASGFTFDDYGMSWVRQAPGKALEWVSAISWNGNNTYYTESMKGRFTISRDNAKNTCYLQMNSLRPEDTAVYYCVKGSTAIVGVPPTYPDEYDYWGQGTLVTVSS

SEQ ID NO: 978 - protein, 127 aa, Artificial Sequence
  VHH
EVQLVESGGGLVQPGGSLRLSCAASGFTFDDYGMSWVRQAPGKALEWVSAISWNGNNTYYTESMKGRFTISRDNAKNTLCLQMNSLRPEDTAVYYCVKGSTAIVGVPPTYPDEYDYWGQGTLVTVSS

SEQ ID NO: 979 - protein, 127 aa, Artificial Sequence
  VHH
EVQLVESGGGLVQPGGSLRLSCAASGFTFDDYGMSWVRQAPGKALEWVSAISWNGNNTYYTESMKGRFTISRDNAKNTLYCQMNSLRPEDTAVYYCVKGSTAIVGVPPTYPDEYDYWGQGTLVTVSS

SEQ ID NO: 980 - protein, 127 aa, Artificial Sequence
  VHH
EVQLVESGGGLVQPGGSLRLSCAASGFTFDDYGMSWVRQAPGKALEWVSAISWNGNNTYYTESMKGRFTISRDNAKNTLYLCMNSLRPEDTAVYYCVKGSTAIVGVPPTYPDEYDYWGQGTLVTVSS

SEQ ID NO: 981 - protein, 127 aa, Artificial Sequence
  VHH
EVQLVESGGGLVQPGGSLRLSCAASGFTFDDYGMSWVRQAPGKALEWVSAISWNGNNTYYTESMKGRFTISRDNAKNTLYLQCNSLRPEDTAVYYCVKGSTAIVGVPPTYPDEYDYWGQGTLVTVSS

SEQ ID NO: 982 - protein, 127 aa, Artificial Sequence
  VHH
EVQLVESGGGLVQPGGSLRLSCAASGFTFDDYGMSWVRQAPGKALEWVSAISWNGNNTYYTESMKGRFTISRDNAKNTLYLQMCSLRPEDTAVYYCVKGSTAIVGVPPTYPDEYDYWGQGTLVTVSS

SEQ ID NO: 983 - protein, 127 aa, Artificial Sequence
  VHH
EVQLVESGGGLVQPGGSLRLSCAASGFTFDDYGMSWVRQAPGKALEWVSAISWNGNNTYYTESMKGRFTISRDNAKNTLYLQMNCLRPEDTAVYYCVKGSTAIVGVPPTYPDEYDYWGQGTLVTVSS

SEQ ID NO: 984 - protein, 127 aa, Artificial Sequence
  VHH
EVQLVESGGGLVQPGGSLRLSCAASGFTFDDYGMSWVRQAPGKALEWVSAISWNGNNTYYTESMKGRFTISRDNAKNTLYLQMNSCRPEDTAVYYCVKGSTAIVGVPPTYPDEYDYWGQGTLVTVSS

SEQ ID NO: 985 - protein, 127 aa, Artificial Sequence
  VHH
EVQLVESGGGLVQPGGSLRLSCAASGFTFDDYGMSWVRQAPGKALEWVSAISWNGNNTYYTESMKGRFTISRDNAKNTLYLQMNSLCPEDTAVYYCVKGSTAIVGVPPTYPDEYDYWGQGTLVTVSS

SEQ ID NO: 986 - protein, 127 aa, Artificial Sequence
  VHH
EVQLVESGGGLVQPGGSLRLSCAASGFTFDDYGMSWVRQAPGKALEWVSAISWNGNNTYYTESMKGRFTISRDNAKNTLYLQMNSLRCEDTAVYYCVKGSTAIVGVPPTYPDEYDYWGQGTLVTVSS

SEQ ID NO: 987 - protein, 127 aa, Artificial Sequence
  VHH
EVQLVESGGGLVQPGGSLRLSCAASGFTFDDYGMSWVRQAPGKALEWVSAISWNGNNTYYTESMKGRFTISRDNAKNTLYLQMNSLRPCDTAVYYCVKGSTAIVGVPPTYPDEYDYWGQGTLVTVSS

SEQ ID NO: 988 - protein, 127 aa, Artificial Sequence
  VHH
EVQLVESGGGLVQPGGSLRLSCAASGFTFDDYGMSWVRQAPGKALEWVSAISWNGNNTYYTESMKGRFTISRDNAKNTLYLQMNSLRPECTAVYYCVKGSTAIVGVPPTYPDEYDYWGQGTLVTVSS

SEQ ID NO: 989 - protein, 127 aa, Artificial Sequence
  VHH
EVQLVESGGGLVQPGGSLRLSCAASGFTFDDYGMSWVRQAPGKALEWVSAISWNGNNTYYTESMKGRFTISRDNAKNTLYLQMNSLRPEDCAVYYCVKGSTAIVGVPPTYPDEYDYWGQGTLVTVSS

SEQ ID NO: 990 - protein, 127 aa, Artificial Sequence
  VHH
EVQLVESGGGLVQPGGSLRLSCAASGFTFDDYGMSWVRQAPGKALEWVSAISWNGNNTYYTESMKGRFTISRDNAKNTLYLQMNSLRPEDTCVYYCVKGSTAIVGVPPTYPDEYDYWGQGTLVTVSS

SEQ ID NO: 991 - protein, 127 aa, Artificial Sequence
  VHH
EVQLVESGGGLVQPGGSLRLSCAASGFTFDDYGMSWVRQAPGKALEWVSAISWNGNNTYYTESMKGRFTISRDNAKNTLYLQMNSLRPEDTACYYCVKGSTAIVGVPPTYPDEYDYWGQGTLVTVSS

SEQ ID NO: 992 - protein, 127 aa, Artificial Sequence
  VHH
EVQLVESGGGLVQPGGSLRLSCAASGFTFDDYGMSWVRQAPGKALEWVSAISWNGNNTYYTESMKGRFTISRDNAKNTLYLQMNSLRPEDTAVCYCVKGSTAIVGVPPTYPDEYDYWGQGTLVTVSS

SEQ ID NO: 993 - protein, 127 aa, Artificial Sequence
  VHH
EVQLVESGGGLVQPGGSLRLSCAASGFTFDDYGMSWVRQAPGKALEWVSAISWNGNNTYYTESMKGRFTISRDNAKNTLYLQMNSLRPEDTAVYCCVKGSTAIVGVPPTYPDEYDYWGQGTLVTVSS

SEQ ID NO: 994 - protein, 127 aa, Artificial Sequence
  VHH
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCCKGSTAIVGVPPTYPDEYDYWGQGTLVTVSS

SEQ ID NO: 995 - protein, 127 aa, Artificial Sequence
  VHH
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVCGSTAIVGVPPTYPDEYDYWGQGTLVTVSS

SEQ ID NO: 996 - protein, 127 aa, Artificial Sequence
  VHH
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYCGQGTLVTVSS

SEQ ID NO: 997 - protein, 127 aa, Artificial Sequence
  VHH
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWCQGTLVTVSS

SEQ ID NO: 998 - protein, 127 aa, Artificial Sequence
  VHH
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGCGTLVTVSS

SEQ ID NO: 999 - protein, 127 aa, Artificial Sequence
  VHH
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQCTLVTVSS

SEQ ID NO: 1000 - protein, 127 aa, Artificial Sequence
  VHH
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGCLVTVSS

SEQ ID NO: 1001 - protein, 127 aa, Artificial Sequence
  VHH
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTCVTVSS

SEQ ID NO: 1002 - protein, 127 aa, Artificial Sequence
  VHH
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLCTVSS

SEQ ID NO: 1003 - protein, 127 aa, Artificial Sequence
  VHH
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVCVSS

SEQ ID NO: 1004 - protein, 127 aa, Artificial Sequence
  VHH
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTCSS

SEQ ID NO: 1005 - protein, 127 aa, Artificial Sequence
  VHH
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVCS

SEQ ID NO: 1006 - protein, 127 aa, Artificial Sequence
  VHH
EVQLVESGGGLVQPGGSLRLSCAASGFTFDDYGMSWVRQAPGKALEWVSAISWNGNNTYYTESMKGRFTISRDNAKNTLYLQMNSLRPEDTAVYYCVKGSTAIVGVPPTYPDEYDYWGQGTLVTVSC

SEQ ID NO: 1007 - protein, 447 aa, Artificial Sequence
  Hch
QVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 1008 - protein, 213 aa, Artificial Sequence
  Lch
QIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1009 - protein, 328 aa, Artificial Sequence; identical to SEQ ID NO: 18
  CH

SEQ ID NO: 1010 - protein, 119 aa, Artificial Sequence
  VH
QVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYSLDYWGQGTTLTVSS

SEQ ID NO: 1011 - protein, 107 aa, Artificial Sequence [sequence omitted]

SEQ ID NO: 1012 - protein, 106 aa, Artificial Sequence [sequence omitted]

SEQ ID NO: 1013 - protein, 444 aa, Artificial Sequence
  Hch
QVQLQQSGPQLVRPGASVKISCKASGYSFTSYWMHWVNQRPGQGLEWIGMIDPSYSETRLNQKFKDKATLTVDKSSSTAYMQLSSPTSEDSAVYYCALYGNYFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 1014 - protein, 214 aa, Artificial Sequence
  Lch
DIQMTQSSSSFSVSLGDRVTITCKASEDIYNRLAWYQQKPGNAPRLLISGATSLETGVPSRFSGSGSGKDYTLSITSLQTEDVATYYCQQYWSTPYTFGGGTKLEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1015 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVCTLPPSREEMTKNQVSLWCLVKGFYPSDIAVEWESNGQPENNYKTTPPVLDSDGSFFLYSKLTVDKSRWQEGNVFSCSVMHEALHNHYTQKSLSLSP

SEQ ID NO: 1016 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSRCEMTKNQVSLSCAVKGFYPSDIAVEWESNGQPENNYKTTPPVLDSDGSFFLVSKLTVDKSRWQEGNVFSCSVMHEALHNHYTQKSLSLSP

SEQ ID NO: 1017 - protein, 328 aa, Artificial Sequence; identical to SEQ ID NO: 88
  CH

SEQ ID NO: 1018 - protein, 328 aa, Artificial Sequence; identical to SEQ ID NO: 89
  CH

SEQ ID NO: 1019 - protein, 328 aa, Artificial Sequence; identical to SEQ ID NO: 128
  CH

SEQ ID NO: 1020 - protein, 107 aa, Artificial Sequence; identical to SEQ ID NO: 231
  CL

SEQ ID NO: 1021 - protein, 107 aa, Artificial Sequence; identical to SEQ ID NO: 298
  CL

SEQ ID NO: 1022 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSCSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVCTLPPSREEMTKNQVSLWCLVKGFYPSDIAVEWESNGQPENNYKTTPPVLDSDGSFFLYSKLTVDKSRWQEGNVFSCSVMHEALHNHYTQKSLSLSP

SEQ ID NO: 1023 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTCPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSRCEMTKNQVSLSCAVKGFYPSDIAVEWESNGQPENNYKTTPPVLDSDGSFFLVSKLTVDKSRWQEGNVFSCSVMHEALHNHYTQKSLSLSP

SEQ ID NO: 1024 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVCSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSRCEMTKNQVSLSCAVKGFYPSDIAVEWESNGQPENNYKTTPPVLDSDGSFFLVSKLTVDKSRWQEGNVFSCSVMHEALHNHYTQKSLSLSP

SEQ ID NO: 1025 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPCSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSRCEMTKNQVSLSCAVKGFYPSDIAVEWESNGQPENNYKTTPPVLDSDGSFFLVSKLTVDKSRWQEGNVFSCSVMHEALHNHYTQKSLSLSP

SEQ ID NO: 1026 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSCSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSRCEMTKNQVSLSCAVKGFYPSDIAVEWESNGQPENNYKTTPPVLDSDGSFFLVSKLTVDKSRWQEGNVFSCSVMHEALHNHYTQKSLSLSP

SEQ ID NO: 1027 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSCLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSRCEMTKNQVSLSCAVKGFYPSDIAVEWESNGQPENNYKTTPPVLDSDGSFFLVSKLTVDKSRWQEGNVFSCSVMHEALHNHYTQKSLSLSP

SEQ ID NO: 1028 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSCGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSRCEMTKNQVSLSCAVKGFYPSDIAVEWESNGQPENNYKTTPPVLDSDGSFFLVSKLTVDKSRWQEGNVFSCSVMHEALHNHYTQKSLSLSP

SEQ ID NO: 1029 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLCTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSRCEMTKNQVSLSCAVKGFYPSDIAVEWESNGQPENNYKTTPPVLDSDGSFFLVSKLTVDKSRWQEGNVFSCSVMHEALHNHYTQKSLSLSP

SEQ ID NO: 1030 - protein, 328 aa, Artificial Sequence
  CH
ASTKGPSVFPLAPSSKRRRRGTAALGCLVKDYFPEPVTVSWNSGALTSGVHTFPAVLQSSGLYSLSSVVTVPSRRRRRRTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVCTLPPSREEMTKNQVSLWCLVKGFYPSDIAVEWESNGQPENNYKTTPPVLDSDGSFFLYSKLTVDKSRWQEGNVFSCSVMHEALHNHYTQKSLSLSP

SEQ ID NO: 1031 - protein, 328 aa, Artificial Sequence
  CH
ASTKGPSVFPLAPSSKDDDDGTAALGCLVKDYFPEPVTVSWNSGALTSGVHTFPAVLQSSGLYSLSSVVTVPSDDDDDDTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSRCEMTKNQVSLSCAVKGFYPSDIAVEWESNGQPENNYKTTPPVLDSDGSFFLVSKLTVDKSRWQEGNVFSCSVMHEALHNHYTQKSLSLSP

SEQ ID NO: 1032 - protein, 328 aa, Artificial Sequence
  CH
ASTKGPSVFPLAPSSKEEEEGTAALGCLVKDYFPEPVTVSWNSGALTSGVHTFPAVLQSSGLYSLSSVVTVPSEEEEEETYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSRCEMTKNQVSLSCAVKGFYPSDIAVEWESNGQPENNYKTTPPVLDSDGSFFLVSKLTVDKSRWQEGNVFSCSVMHEALHNHYTQKSLSLSP

SEQ ID NO: 1033 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTSPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 1034 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPSPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 1035 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTSPPSPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 1036 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSCSLGTQTYICNVNHKPSNTKVDKRVEPKSCDKTHTSPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 1037 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSCSLGTQTYICNVNHKPSNTKVDKRVEPKSCDKTHTCPPSPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 1038 - protein, 328 aa, Artificial Sequence
  CH
ASTKGPSVFPLAPSSKSTSGGTAALGCLVKDYFPEPVTVSWNSGALTSGVHTFPAVLQSSGLYSLSSVVTVPSCSLGTQTYICNVNHKPSNTKVDKRVEPKSCDKTHTSPPSPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 1039 - protein, 450 aa, Artificial Sequence
  Hch
QVQLVESGGGVVQPGGSLRLSCAASGFTFSNAWMHWVRQAPGKGLEWVAQIKDKSQNYATYVAESVKGRFTISRADSKNSIYLQMNSLKTEDTAVYYCRYVHYAAGYGVDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELRGGPKVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPYLDSDGSFFLYSKLTVDKSRWQQGNVFSCSVMHEALHNHYTQESLSLSP

SEQ ID NO: 1040 - protein, 219 aa, Artificial Sequence; identical to SEQ ID NO: 11
  Lch

SEQ ID NO: 1041 - protein, 450 aa, Artificial Sequence; identical to SEQ ID NO: 1039
  Hch

SEQ ID NO: 1042 - protein, 219 aa, Artificial Sequence; identical to SEQ ID NO: 10
  Lch

SEQ ID NO: 1043 - protein, 447 aa, Artificial Sequence; identical to SEQ ID NO: 5
  Hch

SEQ ID NO: 1044 - protein, 213 aa, Artificial Sequence; identical to SEQ ID NO: 12
  Lch

SEQ ID NO: 1045 - protein, 450 aa, Artificial Sequence
  Hch
QVQLVESGGGVVQPGGSLRLSCAASGFTFSNAWMHWVRQAPGKGLEWVAQIKDKSQNYATYVAESVKGRFTISRADSKNSIYLQMNSLKTEDTAVYYCRYVHYAAGYGVDIWGQGTTVTVSSASTKGPSVFPLAPSSKSTSGGTAALGCLVKDYFPEPVTVSWNSGALTSGVHTFPAVLQSSGLYSLSSVVTVPSCSLGTQTYICNVNHKPSNTKVDKKVEPKSCDKTHTCPPCPAPELRGGPKVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPYLDSDGSFFLYSKLTVDKSRWQQGNVFSCSVMHEALHNHYTQESLSLSP

SEQ ID NO: 1046 - protein, 219 aa, Artificial Sequence; identical to SEQ ID NO: 10
  Lch

SEQ ID NO: 1047 - protein, 447 aa, Artificial Sequence; identical to SEQ ID NO: 8
  Hch

SEQ ID NO: 1048 - protein, 213 aa, Artificial Sequence; identical to SEQ ID NO: 12
  Lch

SEQ ID NO: 1049 - protein, 450 aa, Artificial Sequence; identical to SEQ ID NO: 1039
  Hch

SEQ ID NO: 1050 - protein, 219 aa, Artificial Sequence; identical to SEQ ID NO: 11
  Lch

SEQ ID NO: 1051 - protein, 447 aa, Artificial Sequence; identical to SEQ ID NO: 8
  Hch

SEQ ID NO: 1052 - protein, 213 aa, Artificial Sequence; identical to SEQ ID NO: 12
  Lch

SEQ ID NO: 1053 - protein, 447 aa, Artificial Sequence; identical to SEQ ID NO: 5
  Hch

SEQ ID NO: 1054 - protein, 213 aa, Artificial Sequence; identical to SEQ ID NO: 12
  Lch

SEQ ID NO: 1055 - protein, 447 aa, Artificial Sequence; identical to SEQ ID NO: 8
  Hch

SEQ ID NO: 1056 - protein, 213 aa, Artificial Sequence; identical to SEQ ID NO: 12
  Lch

SEQ ID NO: 1057 - protein, 450 aa, Artificial Sequence; identical to SEQ ID NO: 1039
  Hch

SEQ ID NO: 1058 - protein, 219 aa, Artificial Sequence; identical to SEQ ID NO: 11
  Lch

SEQ ID NO: 1059 - protein, 447 aa, Artificial Sequence; identical to SEQ ID NO: 5
  Hch

SEQ ID NO: 1060 - protein, 213 aa, Artificial Sequence; identical to SEQ ID NO: 12
  Lch

SEQ ID NO: 1061-1112 - skipped (52 entries)

SEQ ID NO: 1113 - protein, 447 aa, Artificial Sequence; identical to SEQ ID NO: 5
  Hch

SEQ ID NO: 1114 - protein, 213 aa, Artificial Sequence; identical to SEQ ID NO: 12
  Lch

SEQ ID NO: 1115 - protein, 456 aa, Artificial Sequence
  Hch
QVQLQESGPGVVKPSGTLSLTCAISGGSIGSGGSIRSTRWWSWVRQSPGKGLEWIGEIYHSGSTNYNPSLKSRVTISLDKSRNHFSLRLNSVTAADTAVYYCARQDYGDSGDWYFDLWGKGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELRGGPKVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPYLDSDGSFFLYSKLTVDKSRWQQGNVFSCSVMHEALHNHYTQESLSLSP

SEQ ID NO: 1116 - protein, 217 aa, Artificial Sequence
  Lch
NFMLTQPHSVSESPGKTVTISCTRSSGSIASNSVQWYQQRPGSSPTTVIYEDNQRPSGVPDRFSGSIDSSSNSASLTVSGLKTEDEADYYCQSSDSSAVVFGSGTKLTVLRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1117 - protein, 447 aa, Artificial Sequence; identical to SEQ ID NO: 5
  Hch

SEQ ID NO: 1118 - protein, 213 aa, Artificial Sequence
  Lch
QIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINRTVAAPSVFIFPPSDEQLCSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1119 - protein, 456 aa, Artificial Sequence; identical to SEQ ID NO: 1115
  Hch

SEQ ID NO: 1120 - protein, 217 aa, Artificial Sequence
  Lch
NFMLTQPHSVSESPGKTVTISCTRSSGSIASNSVQWYQQRPGSSPTTVIYEDNQRPSGVPDRFSGSIDSSSNSASLTVSGLKTEDEADYYCQSSDSSAVVFGSGTKLTVLRTVAAPSVFIFPPSDEQLCSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1121 - protein, 447 aa, Artificial Sequence; identical to SEQ ID NO: 8
  Hch

SEQ ID NO: 1122 - protein, 213 aa, Artificial Sequence; identical to SEQ ID NO: 12
  Lch

SEQ ID NO: 1123 - protein, 456 aa, Artificial Sequence
  Hch
QVQLQESGPGVVKPSGTLSLTCAISGGSIGSGGSIRSTRWWSWVRQSPGKGLEWIGEIYHSGSTNYNPSLKSRVTISLDKSRNHFSLRLNSVTAADTAVYYCARQDYGDSGDWYFDLWGKGTMVTVSSASTKGPSVFPLAPSSKSTSGGTAALGCLVKDYFPEPVTVSWNSGALTSGVHTFPAVLQSSGLYSLSSVVTVPSCSLGTQTYICNVNHKPSNTKVDKKVEPKSCDKTHTCPPCPAPELRGGPKVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPYLDSDGSFFLYSKLTVDKSRWQQGNVFSCSVMHEALHNHYTQESLSLSP

SEQ ID NO: 1124 - protein, 217 aa, Artificial Sequence; identical to SEQ ID NO: 1116
  Lch

SEQ ID NO: 1125 - protein, 447 aa, Artificial Sequence; identical to SEQ ID NO: 8
  Hch

SEQ ID NO: 1126 - protein, 213 aa, Artificial Sequence; identical to SEQ ID NO: 12
  Lch

SEQ ID NO: 1127 - protein, 456 aa, Artificial Sequence; identical to SEQ ID NO: 1115
  Hch

SEQ ID NO: 1128 - protein, 217 aa, Artificial Sequence; identical to SEQ ID NO: 1120
  Lch

SEQ ID NO: 1129 - protein, 447 aa, Artificial Sequence; identical to SEQ ID NO: 5
  Hch

SEQ ID NO: 1130 - protein, 213 aa, Artificial Sequence; identical to SEQ ID NO: 12
  Lch

SEQ ID NO: 1131 - protein, 448 aa, Artificial Sequence
  Hch
DVQLQESGPGLVKPSQSLSLTCTVTGYSITSDYAWNWIRQFPGNKLEWMGYINYSGSTSYNPSLKSRISITRDTSKNQFFLQLNSVTTEDTATYYCARWIGSSAWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELRGGPKVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPYLDSDGSFFLYSKLTVDKSRWQQGNVFSCSVMHEALHNHYTQESLSLSP

SEQ ID NO: 1132 - protein, 219 aa, Artificial Sequence
  Lch
DVLMTQTPLSLPVSLGDQASISCRSGQNIVHSNGNTYLEWYLQKPGQSPKLLIYKVSNRFFGVPDRISGSGSGTDFTLKISRVEAEDLGVYFCFQGSHVPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1133 - protein, 447 aa, Artificial Sequence; identical to SEQ ID NO: 8
  Hch

SEQ ID NO: 1134 - protein, 213 aa, Artificial Sequence; identical to SEQ ID NO: 12
  Lch

SEQ ID NO: 1135 - protein, 448 aa, Artificial Sequence
  Hch
DVQLQESGPGLVKPSQSLSLTCTVTGYSITSDYAWNWIRQFPGNKLEWMGYINYSGSTSYNPSLKSRISITRDTSKNQFFLQLNSVTTEDTATYYCARWIGSSAWYFDVWGAGTTVTVSSASTKGPSVFPLAPSSKSTSGGTAALGCLVKDYFPEPVTVSWNSGALTSGVHTFPAVLQSSGLYSLSSVVTVPSCSLGTQTYICNVNHKPSNTKVDKKVEPKSCDKTHTCPPCPAPELRGGPKVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPYLDSDGSFFLYSKLTVDKSRWQQGNVFSCSVMHEALHNHYTQESLSLSP

SEQ ID NO: 1136 - protein, 219 aa, Artificial Sequence; identical to SEQ ID NO: 1132
  Lch

SEQ ID NO: 1137 - protein, 447 aa, Artificial Sequence; identical to SEQ ID NO: 8
  Hch

SEQ ID NO: 1138 - protein, 213 aa, Artificial Sequence; identical to SEQ ID NO: 12
  Lch

SEQ ID NO: 1139 - protein, 448 aa, Artificial Sequence; identical to SEQ ID NO: 1131
  Hch

SEQ ID NO: 1140 - protein, 219 aa, Artificial Sequence
  Lch
DVLMTQTPLSLPVSLGDQASISCRSGQNIVHSNGNTYLEWYLQKPGQSPKLLIYKVSNRFFGVPDRISGSGSGTDFTLKISRVEAEDLGVYFCFQGSHVPFTFGSGTKLEIKRTVAAPSVFIFPPSDEQLCSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1141 - protein, 450 aa, Artificial Sequence; identical to SEQ ID NO: 4
  Hch

SEQ ID NO: 1142 - protein, 219 aa, Artificial Sequence; identical to SEQ ID NO: 10
  Lch

SEQ ID NO: 1143 - protein, 448 aa, Artificial Sequence
  Hch
QVQLQQSGAELVKPGASVKMSCKAFGYTFTTYPIEWMKQNHGKSLEWIGNFHPYNDDTKYNEKFKGKAKLTVEKSSTTVYLELSRLTSDDSAVYYCARENYGSHGGFVYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELRGGPKVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPYLDSDGSFFLYSKLTVDKSRWQQGNVFSCSVMHEALHNHYTQESLSLSP

SEQ ID NO: 1144 - protein, 215 aa, Artificial Sequence
  Lch
ENVLTQSPAIMSASPGEKVTMTCRASSSVISSYLHWYQQKSGASPKLWIYSTSNLASGVPDRFSGSGSGTSYSLTISSVEAEDAATYYCQQYNGYPLTFGAGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1145 - protein, 450 aa, Artificial Sequence; identical to SEQ ID NO: 4
  Hch

SEQ ID NO: 1146 - protein, 219 aa, Artificial Sequence; identical to SEQ ID NO: 11
  Lch

SEQ ID NO: 1147 - protein, 448 aa, Artificial Sequence; identical to SEQ ID NO: 1143
  Hch

SEQ ID NO: 1148 - protein, 215 aa, Artificial Sequence
  Lch
ENVLTQSPAIMSASPGEKVTMTCRASSSVISSYLHWYQQKSGASPKLWIYSTSNLASGVPDRFSGSGSGTSYSLTISSVEAEDAATYYCQQYNGYPLTFGAGTKLEIKRTVAAPSVFIFPPSDEQLCSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1149 - protein, 450 aa, Artificial Sequence; identical to SEQ ID NO: 7
  Hch

SEQ ID NO: 1150 - protein, 219 aa, Artificial Sequence; identical to SEQ ID NO: 10
  Lch

SEQ ID NO: 1151 - protein, 448 aa, Artificial Sequence
  Hch
QVQLQQSGAELVKPGASVKMSCKAFGYTFTTYPIEWMKQNHGKSLEWIGNFHPYNDDTKYNEKFKGKAKLTVEKSSTTVYLELSRLTSDDSAVYYCARENYGSHGGFVYWGQGTLVTVSSASTKGPSVFPLAPSSKSTSGGTAALGCLVKDYFPEPVTVSWNSGALTSGVHTFPAVLQSSGLYSLSSVVTVPSCSLGTQTYICNVNHKPSNTKVDKKVEPKSCDKTHTCPPCPAPELRGGPKVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPYLDSDGSFFLYSKLTVDKSRWQQGNVFSCSVMHEALHNHYTQESLSLSP

SEQ ID NO: 1152 - protein, 215 aa, Artificial Sequence; identical to SEQ ID NO: 1144
  Lch

SEQ ID NO: 1153 - protein, 450 aa, Artificial Sequence; identical to SEQ ID NO: 4
  Hch

SEQ ID NO: 1154 - protein, 219 aa, Artificial Sequence; identical to SEQ ID NO: 11
  Lch

SEQ ID NO: 1155 - protein, 448 aa, Artificial Sequence; identical to SEQ ID NO: 1151
  Hch

SEQ ID NO: 1156 - protein, 215 aa, Artificial Sequence; identical to SEQ ID NO: 1144
  Lch

SEQ ID NO: 1157 - protein, 450 aa, Artificial Sequence; identical to SEQ ID NO: 7
  Hch

SEQ ID NO: 1158 - protein, 219 aa, Artificial Sequence; identical to SEQ ID NO: 10
  Lch

SEQ ID NO: 1159 - protein, 448 aa, Artificial Sequence; identical to SEQ ID NO: 1143
  Hch

SEQ ID NO: 1160 - protein, 215 aa, Artificial Sequence; identical to SEQ ID NO: 1148
  Lch

SEQ ID NO: 1161 - protein, 447 aa, Artificial Sequence; identical to SEQ ID NO: 5
  Hch

SEQ ID NO: 1162 - protein, 213 aa, Artificial Sequence; identical to SEQ ID NO: 12
  Lch

SEQ ID NO: 1163 - protein, 448 aa, Artificial Sequence; identical to SEQ ID NO: 1143
  Hch

SEQ ID NO: 1164 - protein, 215 aa, Artificial Sequence; identical to SEQ ID NO: 1144
  Lch

SEQ ID NO: 1165 - protein, 447 aa, Artificial Sequence; identical to SEQ ID NO: 5
  Hch

SEQ ID NO: 1166 - protein, 213 aa, Artificial Sequence; identical to SEQ ID NO: 1118
  Lch

SEQ ID NO: 1167 - protein, 448 aa, Artificial Sequence; identical to SEQ ID NO: 1143
  Hch

SEQ ID NO: 1168 - protein, 215 aa, Artificial Sequence; identical to SEQ ID NO: 1148
  Lch

SEQ ID NO: 1169 - protein, 447 aa, Artificial Sequence; identical to SEQ ID NO: 8
  Hch

SEQ ID NO: 1170 - protein, 213 aa, Artificial Sequence; identical to SEQ ID NO: 12
  Lch

SEQ ID NO: 1171 - protein, 448 aa, Artificial Sequence; identical to SEQ ID NO: 1151
  Hch

SEQ ID NO: 1172 - protein, 215 aa, Artificial Sequence; identical to SEQ ID NO: 1144
  Lch

SEQ ID NO: 1173 - protein, 447 aa, Artificial Sequence; identical to SEQ ID NO: 8
  Hch

SEQ ID NO: 1174 - protein, 213 aa, Artificial Sequence; identical to SEQ ID NO: 12
  Lch

SEQ ID NO: 1175 - protein, 448 aa, Artificial Sequence; identical to SEQ ID NO: 1143
  Hch

SEQ ID NO: 1176 - protein, 215 aa, Artificial Sequence; identical to SEQ ID NO: 1148
  Lch

SEQ ID NO: 1177 - protein, 447 aa, Artificial Sequence; identical to SEQ ID NO: 5
  Hch

SEQ ID NO: 1178 - protein, 213 aa, Artificial Sequence; identical to SEQ ID NO: 1118
  Lch

SEQ ID NO: 1179 - protein, 448 aa, Artificial Sequence; identical to SEQ ID NO: 1151
  Hch

SEQ ID NO: 1180 - protein, 215 aa, Artificial Sequence; identical to SEQ ID NO: 1144
  Lch

SEQ ID NO: 1181 - protein, 443 aa, Artificial Sequence
  Hch
QVQLVQSGAEVKKPGASVTVSCKASGYTFTDYEMHWIRQPPGEGLEWIGAIDGPTPDTAYSEKFKGRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELRGGPKVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRKEMTKNQVSLTCLVKGFYPSDIAVEWESNGQPENNYKTTPPYLDSDGSFFLYSKLTVDKSRWQQGNVFSCSVMHEALHNHYTQKSLSLSP

SEQ ID NO: 1182 - protein, 219 aa, Artificial Sequence; identical to SEQ ID NO: 10
  Lch

SEQ ID NO: 1183 - protein, 450 aa, Artificial Sequence
  Hch
QVQLVESGGGVVQPGRSLRLSCAASGFTFSNAWMHWVRQAPGKGLEWVAQIKAKSNNYATYYAESVKGRFTISRDDSKNSLYLQMNSLKTEDTAVYYCRYAHYGAYYGVDAWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELRGGPKVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPYLDSDGSFFLYSKLTVDKSRWQQGNVFSCSVMHEALHNHYTQESLSLSP

SEQ ID NO: 1184 - protein, 219 aa, Artificial Sequence; identical to SEQ ID NO: 10
  Lch

SEQ ID NO: 1185 - protein, 443 aa, Artificial Sequence; identical to SEQ ID NO: 1181
  Hch

SEQ ID NO: 1186 - protein, 219 aa, Artificial Sequence; identical to SEQ ID NO: 11
  Lch

SEQ ID NO: 1187 - protein, 450 aa, Artificial Sequence; identical to SEQ ID NO: 1183
  Hch

SEQ ID NO: 1188 - protein, 219 aa, Artificial Sequence; identical to SEQ ID NO: 11
  Lch

SEQ ID NO: 1189 - protein, 444 aa, Artificial Sequence
  Hch
QVQLQQSGPQLVRPGASVKISCKASGYSFTSYWMHWVNQRPGQGLEWIGMIDPSYSETRLNQKFKDKATLTVDKSSSTAYMQLSSPTSEDSAVYYCALYGNYFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELRGGPKVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPYLDSDGSFFLYSKLTVDKSRWQQGNVFSCSVMHEALHNHYTQESLSLSP

SEQ ID NO: 1190 - protein, 214 aa, Artificial Sequence; identical to SEQ ID NO: 1014
  Lch

SEQ ID NO: 1191 - protein, 450 aa, Artificial Sequence
  Hch
QVQLVESGGGVVQPGRSLRLSCAASGFTFSNAWMHWVRQAPGKGLEWVAQIKAKSNNYATYYAESVKGRFTISRDDSKNSLYLQMNSLKTEDTAVYYCRYAHYGAYYGVDAWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELRGGPKVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRKEMTKNQVSLTCLVKGFYPSDIAVEWESNGQPENNYKTTPPYLDSDGSFFLYSKLTVDKSRWQQGNVFSCSVMHEALHNHYTQKSLSLSP

SEQ ID NO: 1192 - protein, 219 aa, Artificial Sequence
  Lch
DIVMTQSPLSLPVTPGEPASISCRSSQSLVHSNRNTYLHWYQQKPGQAPRLLIYKVSNRFSGVPDRFSGSGSGTDFTLKISRVEAEDVGVYYCGQGTQVPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1193 - protein, 443 aa, Artificial Sequence
  Hch
QVQLVQSGAEVKKPGASVTVSCKASGYTFTDYEMHWIRQPPGEGLEWIGAIDGPTPDTAYSEKFKGRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELRGGPKVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPYLDSDGSFFLYSKLTVDKSRWQQGNVFSCSVMHEALHNHYTQESLSLSP

SEQ ID NO: 1194 - protein, 219 aa, Artificial Sequence; identical to SEQ ID NO: 10
  Lch

SEQ ID NO: 1195 - protein, 450 aa, Artificial Sequence; identical to SEQ ID NO: 1191
  Hch

SEQ ID NO: 1196 - protein, 219 aa, Artificial Sequence; identical to SEQ ID NO: 1192
  Lch

SEQ ID NO: 1197 - protein, 448 aa, Artificial Sequence
  Hch
QVQLVQSGAEVKKPGASVKVSCKASGYTFTSYYIHWVRQAPGQGLEWIGCIYPGNVNTNYNEKFKDRATLTVDTSISTAYMELSRLRSDDTAVYFCTRSHYGLDWNFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELRGGPKVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRKEMTKNQVSLTCLVKGFYPSDIAVEWESNGQPENNYKTTPPYLDSDGSFFLYSKLTVDKSRWQQGNVFSCSVMHEALHNHYTQKSLSLSP

SEQ ID NO: 1198 - protein, 214 aa, Artificial Sequence; identical to SEQ ID NO: 13
  Lch

SEQ ID NO: 1199 - protein, 446 aa, Artificial Sequence
  Hch
QSLEESGGDLVKPGASLTLTCTASGFSFSSSYWIYWVRQAPGKGLEWIACIYAGSTSSTYYASWAKGRFTISKTSSTTVTLQMTSLTAADTATYFCAKGGPDDAFHSWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELRGGPKVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPYLDSDGSFFLYSKLTVDKSRWQQGNVFSCSVMHEALHNHYTQESLSLSP

SEQ ID NO: 1200 - protein, 216 aa, Artificial Sequence
  Lch
DVVMTQTPASVSEPVGGTVTIKCQASQSIGNYLAWYQQKPGQPPKLLIYYASNLASGVSSRFKGSRSGTEFTLTISDLECADAATYYCQCAYYESSYVTFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1201 - protein, 448 aa, Artificial Sequence
  Hch
QVQLVQSGAEVKKPGASVKVSCKASGYTFTSYYIHWVRQAPGQGLEWIGCIYPGNVNTNYNEKFKDRATLTVDTSISTAYMELSRLRSDDTAVYFCTRSHYGLDWNFDVWGQGTTVTVSSASTKGPSVFPLAPSSKSTSGGTAALGCLVKDYFPEPVTVSWNSGALTSGVHTFPAVLQSSGLYSLSSVVTVPSCSLGTQTYICNVNHKPSNTKVDKKVEPKSCDKTHTCPPCPAPELRGGPKVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRKEMTKNQVSLTCLVKGFYPSDIAVEWESNGQPENNYKTTPPYLDSDGSFFLYSKLTVDKSRWQQGNVFSCSVMHEALHNHYTQKSLSLSP

SEQ ID NO: 1202 - protein, 214 aa, Artificial Sequence; identical to SEQ ID NO: 13
  Lch

SEQ ID NO: 1203 - protein, 446 aa, Artificial Sequence
  Hch
QSLEESGGDLVKPGASLTLTCTASGFSFSSSYWIYWVRQAPGKGLEWIACIYAGSTSSTYYASWAKGRFTISKTSSTTVTLQMTSLTAADTATYFCAKGGPDDAFHSWGPGTLVTVSSASTKGPSVFPLAPSSKSTSGGTAALGCLVKDYFPEPVTVSWNSGALTSGVHTFPAVLQSSGLYSLSSVVTVPSCSLGTQTYICNVNHKPSNTKVDKKVEPKSCDKTHTCPPCPAPELRGGPKVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPYLDSDGSFFLYSKLTVDKSRWQQGNVFSCSVMHEALHNHYTQESLSLSP

SEQ ID NO: 1204 - protein, 216 aa, Artificial Sequence; identical to SEQ ID NO: 1200
  Lch

SEQ ID NO: 1205 - protein, 444 aa, Artificial Sequence
  Hch
QVQLQQSGPQLVRPGASVKISCKASGYSFTSYWMHWVNQRPGQGLEWIGMIDPSYSETRLNQKFKDKATLTVDKSSSTAYMQLSSPTSEDSAVYYCALYGNYFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPDLLGGDSVFLFPPKPKDTLMISRTPEVTCVVIDVAEEDGEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 1206 - protein, 214 aa, Artificial Sequence; identical to SEQ ID NO: 1014
  Lch

SEQ ID NO: 1207 - protein, 448 aa, Artificial Sequence
  Hch
QVQLLESGPELLKPGASVKMSCKASGYTFTDYNMHWVKQSHGKSLEWIGYIYPYTGGTGYNQKFKNKATLTVDSSSSTAYMELRSLTSEDSAVYYCARNFRYTYWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPDLLGGDSVFLFPPKPKDTLMISRTPEVTCVVIDVAEEDGEVKFNWYVDGVEVHNAKTKPREEQYNSTYRVVSVLTVLHQDWLNGKEYKCKVSNKALPAPIEKTISKAKGQPREPQVYTLPPSRKEMTKNQVSLTCLVKGFYPSDIAVEWESNGQPENNYKTTPPYLDSDGSFFLYSKLTVDKSRWQQGNVFSCSVMHEALHNHYTQKSLSLSP

SEQ ID NO: 1208 - protein, 220 aa, Artificial Sequence
  Lch
DIVMTQSPASLAVSLGQRATISCRASESVDSYDNSLMHWYQQKPGQPPKVLIYLASNLESGVPARFSGSGSRTDFTLTIDPVEADDAATYYCQQNNEDPYTFGGGTKLEIKRRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1209 - protein, 448 aa, Artificial Sequence
  Hch
QVQLVQSGAEVKKPGASVKVSCKASGYTFTSYYIHWVRQAPGQGLEWIGCIYPGNVNTNYNEKFKDRATLTVDTSISTAYMELSRLRSDDTAVYFCTRSHYGLDWNFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPDLLGGDSVFLFPPKPKDTLMISRTPEVTCVVIDVAEEDGEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPYLDSDGSFFLYSKLTVDKSRWQQGNVFSCSVMHEALHNHYTQESLSLSP

SEQ ID NO: 1210 - protein, 214 aa, Artificial Sequence; identical to SEQ ID NO: 13
  Lch

SEQ ID NO: 1211 - protein, 448 aa, Artificial Sequence
  Hch
QVQLLESGPELLKPGASVKMSCKASGYTFTDYNMHWVKQSHGKSLEWIGYIYPYTGGTGYNQKFKNKATLTVDSSSSTAYMELRSLTSEDSAVYYCARNFRYTYWYFDVWGQGTTVTVSSASTKGPSVFPLAPSSKSTSGGTAALGCLVKDYFPEPVTVSWNSGALTSGVHTFPAVLQSSGLYSLSSVVTVPSCSLGTQTYICNVNHKPSNTKVDKKVEPKSCDKTHTCPPCPAPDLLGGDSVFLFPPKPKDTLMISRTPEVTCVVIDVAEEDGEVKFNWYVDGVEVHNAKTKPREEQYNSTYRVVSVLTVLHQDWLNGKEYKCKVSNKALPAPIEKTISKAKGQPREPQVYTLPPSRKEMTKNQVSLTCLVKGFYPSDIAVEWESNGQPENNYKTTPPYLDSDGSFFLYSKLTVDKSRWQQGNVFSCSVMHEALHNHYTQKSLSLSP

SEQ ID NO: 1212 - protein, 220 aa, Artificial Sequence; identical to SEQ ID NO: 1208
  Lch

SEQ ID NO: 1213 - protein, 448 aa, Artificial Sequence
  Hch
QVQLVQSGAEVKKPGASVKVSCKASGYTFTSYYIHWVRQAPGQGLEWIGCIYPGNVNTNYNEKFKDRATLTVDTSISTAYMELSRLRSDDTAVYFCTRSHYGLDWNFDVWGQGTTVTVSSASTKGPSVFPLAPSSKSTSGGTAALGCLVKDYFPEPVTVSWNSGALTSGVHTFPAVLQSSGLYSLSSVVTVPSCSLGTQTYICNVNHKPSNTKVDKKVEPKSCDKTHTCPPCPAPDLLGGDSVFLFPPKPKDTLMISRTPEVTCVVIDVAEEDGEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPYLDSDGSFFLYSKLTVDKSRWQQGNVFSCSVMHEALHNHYTQESLSLSP

SEQ ID NO: 1214 - protein, 214 aa, Artificial Sequence; identical to SEQ ID NO: 13
  Lch

SEQ ID NO: 1215-1218 - skipped (4 entries)

SEQ ID NO: 1219 - protein, 448 aa, Artificial Sequence; identical to SEQ ID NO: 1207
  Hch

SEQ ID NO: 1220 - protein, 220 aa, Artificial Sequence
  Lch
DIVMTQSPASLAVSLGQRATISCRASESVDSYDNSLMHWYQQKPGQPPKVLIYLASNLESGVPARFSGSGSRTDFTLTIDPVEADDAATYYCQQNNEDPYTFGGGTKLEIKRRRTVAAPSVFIFPPSDEQLCSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1221 - protein, 448 aa, Artificial Sequence; identical to SEQ ID NO: 1209
  Hch

SEQ ID NO: 1222 - protein, 214 aa, Artificial Sequence; identical to SEQ ID NO: 14
  Lch

SEQ ID NO: 1223 - protein, 448 aa, Artificial Sequence; identical to SEQ ID NO: 1211
  Hch

SEQ ID NO: 1224 - protein, 220 aa, Artificial Sequence; identical to SEQ ID NO: 1208
  Lch

SEQ ID NO: 1225 - protein, 448 aa, Artificial Sequence; identical to SEQ ID NO: 1209
  Hch

SEQ ID NO: 1226 - protein, 214 aa, Artificial Sequence; identical to SEQ ID NO: 14
  Lch

SEQ ID NO: 1227 - protein, 448 aa, Artificial Sequence; identical to SEQ ID NO: 1207
  Hch

SEQ ID NO: 1228 - protein, 220 aa, Artificial Sequence; identical to SEQ ID NO: 1220
  Lch

SEQ ID NO: 1229 - protein, 448 aa, Artificial Sequence; identical to SEQ ID NO: 1213
  Hch

SEQ ID NO: 1230 - protein, 214 aa, Artificial Sequence; identical to SEQ ID NO: 13
  Lch

SEQ ID NO: 1231 - protein, 447 aa, Artificial Sequence
  Hch
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 1232 - protein, 214 aa, Artificial Sequence
  Lch
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLCSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1233 - protein, 443 aa, Artificial Sequence; identical to SEQ ID NO: 312
  Hch

SEQ ID NO: 1234 - protein, 214 aa, Artificial Sequence; identical to SEQ ID NO: 1232
  Lch

SEQ ID NO: 1235 - protein, 444 aa, Artificial Sequence
  Hch
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSP

SEQ ID NO: 1236 - protein, 214 aa, Artificial Sequence; identical to SEQ ID NO: 1232
  Lch

SEQ ID NO: 1237 - protein, 447 aa, Artificial Sequence
  Hch
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSCSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 1238 - protein, 214 aa, Artificial Sequence [sequence omitted]

SEQ ID NO: 1239 - protein, 447 aa, Artificial Sequence
  Hch
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGCLTSGVHTFPAVLQSSGLYSLSSVVTVPSSSLGTQTYICNVNHKPSNTKVDKRVEPKSCDKTHTCPPCPAPELRRGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSREEMTKNQVSLTCLVKGFYPSDIAVEWESNGQPENNYKTTPPVLDSDGSFFLYSKLTVDKSRWQEGNVFSCSVMHEALHNHYTQKSLSLSP

SEQ ID NO: 1240 - protein, 214 aa, Artificial Sequence [sequence omitted]

SEQ ID NO: 1241 - protein, 580 aa, Homo sapiens
MAGTVRTACLVVAMLLSLDFPGQAQPPPPPPDATCHQVRSFFQRLQPGLKWVPETPVPGSDLQVCLPKGPTCCSRKMEEKYQLTARLNMEQLLQSASMELKFLIIQNAAVFQEAFEIVVRHAKNYTNAMFKNNYPSLTPQAFEFVGEFFTDVSLYILGSDINVDDMVNELFDSLFPVIYTQLMNPGLPDSALDINECLRGARRDLKVFGNFPKLIMTQVSKSLQVTRIFLQALNLGIEVINTTDHLKFSKDCGRMLTRMWYCSYCQGLMMVKPCGGYCNVVMQGCMAGVVEIDKYWREYILSLEELVNGMYRIYDMENVLLGLFSTIHDSIQYVQKNAGKLTTTIGKLCAHSQQRQYRSAYYPEDLFIDKKVLKVAHVEHEETLSSRRRELIQKLKSFISFYSALPGYICSHSPVAENDTLCWNGQELVERYSQKAARNGMKNQFNLHELKMKGPEPVVSQIIDKLKHINQLLRTMSMPKGRVLDKNLDEEGFESGDCGDDEDECIGGSGDGMIKVKNQLRFLAELAYDLDVDDAPGNSQQATPKDNEISTFHNLGNVHSPLKLLTSMAISVVCFFFLVH

The invention claimed is:

1. An antigen-binding molecule comprising a first antigen-binding domain crosslinked with a second antigen-binding domain, according to EU numbering, and the amino acid residue in a CL region is selected from the group consisting of positions 121, 122, 123, 124, 125, 126, 127, and 128, according to Kabat numbering, and wherein said antigen-binding molecule has increased resistance to protease cleavage as compared to a control antigen-binding molecule, wherein the control antigen-binding molecule differs from the antigen-binding molecule only in that the control antigen-binding molecule has one less bond between the two antigen-binding domains.

2. The antigen-binding molecule of claim 1, wherein the antibody fragment of the first and second antigen-binding domains is a Fab, Fab', or scFab.

3. The antigen-binding molecule of claim 1, wherein both the first and the second antigen-binding domains comprise an Fc region.

4. The antigen-binding molecule of claim 1, which has activity of regulating interaction between two antigen molecules.

5. A pharmaceutical composition comprising the antigen-binding molecule of claim 1 and a pharmaceutically acceptable carrier.

6. A method for regulating interaction between two antigen molecules, comprising:
  (a) providing an antigen-binding molecule comprising a first antigen-binding domain and a second antigen-binding domain, wherein the first and second antigen-binding domains comprise a hinge region and each of the first and second antigen-binding domains comprise an antibody fragment which binds to a particular antigen,
  (b) adding to the antigen-binding molecule at least one bond which links the first and second antigen-binding domains, wherein the first and second antigen-binding domains are linked with each other by two or more bonds, wherein at least one of the bonds is a disulfide bond,
    wherein at least one amino acid residue from which a bond between antigen-binding domains originates is present within a CH1 region and/or within a CL region of the antibody fragment of the first and second antigen-binding domains and at least one amino acid residue from which a bond between antigen-binding domains originates is present within a hinge region;
    wherein at least one of the bonds linking the first and second antigen-binding domains is formed by:
  linking an amino acid residue in a CH1 region of the first antigen-binding domain with an amino acid residue in a CH1 region of the second antigen-binding domain,
  wherein at least one of the bonds linking the two antigen-binding domains is formed by linking any two amino acid residues selected from the group consisting of positions 119 to 123, 131 to 140, 148 to 150, 155 to 167, 174 to 178, 188 to 197, and 201 to 214, according to EU numbering, in a CH1 region of the first antigen-binding domain and a CH1 region of the second antigen binding domain,
  linking an amino acid residue in a CL region of the first antigen-binding domain with an amino acid residue in a CL region of the second antigen-binding domain,
  wherein at least one of the bonds linking the two antigen-binding domains is formed by linking any two amino acid residues selected from the group consisting of positions 108, 109, 112, 121, 123, 126, 128, 151, 152, 153, 156, 184, 186, 188, 189, 190, 195, 196, 200, 201, 202, 203, 208, 210, 211, 212, and 213, according to Kabat numbering, in a CL region of the first antigen-binding domain and a CL region of the second antigen-binding domain, or
  linking an amino acid residue in a CH1 region of the first antigen-binding domain with an amino acid residue in a CL region of the second antigen-binding domain,
  wherein the amino acid residue in a CH1 region is selected from the group consisting of positions 188, 189, 190, 191, 192, 193, 194, 195, 196, or 197, according to EU numbering, and the amino acid residue in a CL region is selected from the group consisting of positions 121, 122, 123, 124, 125, 126, 127, and 128, according to Kabat numbering, and
  (c) contacting the antigen-binding molecule produced in (b) with the two antigen molecules, and
  wherein said antigen-binding molecule has increased resistance to protease cleavage as compared to a control antigen-binding molecule, wherein the control antigen-binding molecule differs from the antigen-binding molecule only in that the control antigen-binding molecule has one less bond between the two antigen-binding domains.

7. A method for producing an antigen-binding molecule which has activity of regulating interaction between two antigen molecules, comprising:
  (a) providing a nucleic acid encoding a polypeptide comprising a first antigen-binding domain and a nucleic acid encoding a polypeptide comprising a second antigen-binding domain, wherein the first and second antigen-binding domains comprise a hinge region and the first and second antigen-binding domains each comprises an antibody fragment which binds to a particular antigen,
  (b) introducing a mutation into nucleic acids encoding the first and second antigen-binding domains such that at least one bond linking the first and second antigen-binding domains is added, wherein the first antigen-binding domain and the second antigen-binding domain are linked with each other via two or more bonds, wherein at least one of the bonds is a disulfide bond;
    wherein at least one amino acid residue from which a bond between antigen-binding domains originates is present within a CH1 region and/or within a CL region of at least one the antibody fragment of the first and second antigen-binding domains and at least one amino acid residue from which a bond between the antigen-binding domains originates is present within a hinge region;
  wherein at least one of the bonds linking the two antigen-binding domains is formed by:
  linking an amino acid residue in a CH1 region of the first antigen-binding domain with an amino acid residue in a CH1 region of the second antigen-binding domain,
    wherein at least one of the bonds linking the two antigen-binding domains is formed by linking any two amino acid residues selected from the group consisting of positions 119 to 123, 131 to 140, 148 to 150, 155 to 167, 174 to 178, 188 to 197, and 201 to 214, according to EU numbering, in a CH1 region of the first antigen-binding domain and a CH1 region of the second antigen binding domain,
  linking an amino acid residue in a CL region of the first antigen-binding domain with an amino acid residue in a CL region of the second antigen-binding domain,
  wherein the at least one of the bonds linking the two antigen-binding domains is formed by linking any two amino acid residues selected from the group consisting of positions 108, 109, 112, 121, 123, 126, 128, 151, 152, 153, 156, 184, 186, 188, 189, 190, 195, 196, 200, 201, 202, 203, 208, 210, 211, 212, and 213, according to Kabat numbering, in a CL region of the first antigen-binding domain and a CL region of the second antigen binding domain, or linking an amino acid residue in a CH1 region of the first antigen-binding domain with an amino acid residue in a CL region of the second antigen-binding domain, wherein the amino acid residue in a CH1 region is selected from the group consisting of positions 188, 189, 190, 191, 192, 193, 194, 195, 196, and 197 according to EU numbering, and the amino acid residue in the CL region is selected from the group consisting of positions 121, 122, 123, 124, 125, 126, 127, and 128, according to Kabat numbering, (c) introducing the nucleic acids produced in (b) into a host cell, (d) culturing the host cell such that the two polypeptides are expressed, and (e) obtaining an antigen-binding molecule which is a polypeptide comprising the first and second antigen-binding domains, wherein the first and second antigen-binding domains are linked by two or more bonds, and wherein said antigen-binding molecule has increased resistance to protease cleavage as compared to a control antigen-binding molecule, wherein the control antigen-binding molecule differs from the antigen-binding molecule only in that the control antigen-binding molecule has one less bond between the two antigen-binding domains.

8. A nucleic acid or nucleic acids encoding the antigen-binding molecule of claim 1.

9. A vector comprising the nucleic acid or nucleic acids of claim 8.

10. A host cell comprising the nucleic acid or nucleic acids of claim 8.

11. A method of producing an antigen-binding molecule comprising culturing the host cell of claim 10 under conditions suitable for expression of the antigen-binding molecule, and optionally recovering the antigen-binding molecule.

12. The antigen-binding molecule of claim 1, or the method of claim 6 or 7, wherein at least one bond linking the first and second antigen-binding domains is formed by linking amino acid residues at any one of positions selected from the group consisting of positions 119, 122, 123, 131, 132, 133, 134, 135, 136, 137, 138, 139, 140, 148, 150, 155, 156, 157, 159, 160, 161, 162, 163, 164, 165, 167, 174, 176, 177, 178, 188, 189, 190, 191, 192, 193, 194, 195, 196, 197, 201, 203, 205, 206, 207, 208, 211, 212, 213, 214, 218, and 219, according to EU numbering, in a CH1 region of the two antigen-binding domains with each other.

* * * * *